United States Patent
Sternberg et al.

(12)

(10) Patent No.: US 10,947,534 B2
(45) Date of Patent: Mar. 16, 2021

(54) RNA-GUIDED DNA INTEGRATION USING TN7-LIKE TRANSPOSONS

(71) Applicant: The Trustees of Columbia University in the City of New York, New York, NY (US)

(72) Inventors: Samuel Henry Sternberg, New York, NY (US); Sanne Eveline Klompe, New York, NY (US)

(73) Assignee: THE TRUSTEES OF COLUMBIA UNIVERSITY IN THE CITY OF NEW YORK, New York, NY (US)

( * ) Notice: Subject to any disclaimer, the term of this patent is extended or adjusted under 35 U.S.C. 154(b) by 0 days.

(21) Appl. No.: 16/812,138

(22) Filed: Mar. 6, 2020

(65) Prior Publication Data

US 2020/0283769 A1 Sep. 10, 2020

Related U.S. Application Data

(60) Provisional application No. 62/815,187, filed on Mar. 7, 2019, provisional application No. 62/822,544, filed on Mar. 22, 2019, provisional application No. 62/845,218, filed on May 8, 2019, provisional application No. 62/855,814, filed on May 31, 2019, provisional application No. 62/866,270, filed on Jun. 25, 2019, provisional application No. 62/873,455, filed on Jul. 12, 2019, provisional application No. 62/875,772, filed on Jul. 18, 2019, provisional application No. 62/884,600, filed on Aug. 8, 2019, provisional application No. 62/902,171, filed on Sep. 18, 2019.

(51) Int. Cl.

| C12N 15/113 | (2010.01) |
| C12N 9/22 | (2006.01) |
| C12N 15/63 | (2006.01) |
| C12N 15/90 | (2006.01) |
| C12N 15/10 | (2006.01) |

(52) U.S. Cl.
CPC .............. *C12N 15/113* (2013.01); *C12N 9/22* (2013.01); *C12N 15/102* (2013.01); *C12N 15/63* (2013.01); *C12N 15/902* (2013.01); *C12N 2310/20* (2017.05)

(58) Field of Classification Search
None
See application file for complete search history.

(56) References Cited

U.S. PATENT DOCUMENTS

| 5,451,513 A | 9/1995 | Maliga et al. |
| 5,545,817 A | 8/1996 | McBride et al. |
| 5,545,818 A | 8/1996 | McBride et al. |
| 5,576,198 A | 11/1996 | McBride et al. |
| 5,958,775 A | 9/1999 | Wickstrom et al. |
| 7,608,434 B2 | 10/2009 | Reznikoff |
| 8,440,431 B2 | 5/2013 | Voytas et al. |
| 8,697,359 B1 | 4/2014 | Zhang |
| 9,080,211 B2 | 7/2015 | Grunenwald et al. |
| 9,109,225 B2 | 8/2015 | Kim et al. |
| 9,879,283 B2 | 1/2018 | Ravinder et al. |
| 10,136,649 B2 | 11/2018 | Barrangou et al. |
| 2002/0188105 A1 | 12/2002 | Craig |
| 2015/0067922 A1 | 3/2015 | Yang et al. |
| 2017/0059699 A1 | 3/2017 | Mathe et al. |
| 2017/0273284 A1 | 9/2017 | Shen et al. |
| 2020/0190487 A1* | 6/2020 | Zhang .................. C07K 14/195 |

FOREIGN PATENT DOCUMENTS

| CA | 3066599 A1 | 12/2018 |
| WO | WO1995016783 | 6/1995 |
| WO | WO2015148680 A1 | 10/2015 |
| WO | WO2016094867 A1 | 6/2016 |
| WO | WO2017029485 A1 | 2/2017 |
| WO | WO2017049266 A2 | 3/2017 |
| WO | WO2017062668 A2 | 4/2017 |
| WO | WO2017106274 A1 | 6/2017 |
| WO | WO2017117395 A1 | 7/2017 |
| WO | WO2018129296 A1 | 7/2018 |
| WO | WO2018152244 A1 | 8/2018 |
| WO | WO2019090173 A1 | 5/2019 |

OTHER PUBLICATIONS

Klompe et al. Transposon-encoded CRISPR-Cas systems direct RNA-guided DNA integration. Epub Jun. 12, 2019. Nature. vol. 571, pp. 219-225. (Year: 2019).*
McDonald et al. CRISPR-Cas systems are present on mobile genetic elements in *Vibrio* species. Published online Feb. 4, 2019. BMC Genomics. vol. 20, No. 1, pp. 1-23. (Year: 2019).*
Peters et al. Recruitment of CRISPR-Cas systems by Tn7-like transposons. Published online Aug. 15, 2017. PNAS. E7358-7366. (Year: 2017).*
Oost et al. First structural insights into CRISPR-Cas-guided DNA transposition. Published online Mar. 3, 2020. Cell Research. vol. 30, pp. 193-194. (Year: 2020).*
U.S. Appl. No. 62/780,658, filed Dec. 17, 2018, The Broad Institute, Inc.
Adey et al., "Rapid, Low-Input, Low-Bias Construction of Shotgun Fragment Libraries by High-Density in Vitro Transposition" Genome Biol. 2010;11(12):R119. 17 pages.
Arciszewska et al., "Purification of TnsB, a Transposition Protein That Binds to the Ends of Tn7" J Biol Chem. Nov. 15, 1991;266(32):21736-44.
Bainton et al., "Tn7 Transposition in Vitro Proceeds Through an Excised Transposon Intermediate Generated by Staggered Breaks in DNA" Cell. May 31, 1991;65(5):805-16.

(Continued)

*Primary Examiner* — Channing S Mahatan
(74) *Attorney, Agent, or Firm* — Casimir Jones, S.C.

(57) ABSTRACT

In certain embodiments, the present systems and methods use Tn7-like transposons that encode CRISPR-Cas systems for programmable, RNA-guided DNA integration. For example, the CRISPR-Cas machinery directs the Tn7 transposon-associated proteins to integrate DNA downstream of a target site (e.g., a genomic target site) recognized by a guide RNA (gRNA).

9 Claims, 190 Drawing Sheets
(174 of 190 Drawing Sheet(s) Filed in Color)
Specification includes a Sequence Listing.

(56) References Cited

OTHER PUBLICATIONS

Bevan "Binary Agrobacterium Vectors for Plant Transformation" Nucleic Acids Res. Nov. 26, 1984;12(22):8711-21.

Bevan et al., "T-DNA of the Agrobacterium Ti and Ri Plasmids" Annu Rev Genet. 1982;16: 357-84.

Biery et al., "A Simple in Vitro Tn7-based Transposition System With Low Target Site Selectivity for Genome and Gene Analysis" Nucleic Acids Res. Mar. 1, 2000;28(5):1067-77.

Bikard et al., "Exploiting CRISPR-Cas Nucleases to Produce Sequence-Specific Antimicrobials" Nat Biotechnol. Nov. 2014;32(11):1146-50.

Blair et al., "Molecular Mechanisms of Antibiotic Resistance" Nat Rev Microbiol. Jan. 2015;13(1):42-51.

Bokhoven et al., "Insertional Gene Activation by Lentiviral and Gammaretroviral Vectors" J Virol. Jan. 2009;83(1):283-94.

Boulton et al., "Specificity of Agrobacterium-mediated Delivery of Maize Streak Virus DNA to Members of the Gramineae" Plant Mol Biol. Jan. 1989;12(1):31-40.

Boynton et al., "Chloroplast Transformation in Chlamydomonas" Methods Enzymol. 1993;217:510-36.

Carbery et al., "Targeted Genome Modification in Mice Using Zinc-Finger Nucleases" Genetics. Oct. 2010;186(2):451-9.

Cho et al., "Targeted Genome Engineering in Human Cells With the Cas9 RNA-guided Endonuclease" Nat Biotechnol. Mar. 2013;31(3):230-2.

Choi et al., "Direct Interaction Between the TnsA and TnsB Subunits Controls the Heteromeric Tn7 Transposase" Proc Natl Acad Sci U S A. May 28, 2013;110(22):E2038-45.

Choi et al., "The Tn7 transposition regulator TnsC interacts with the transposase subunit TnsB and target selector TnsD" Proc Natl Acad Sci U S A. Jul. 15, 2014;111(28):E2858-65.

Christou et al., "Production of Transgenic Rice (*Oryza sativa* L.) Plants from Agronomically Important Indica and Japonica Varieties via Electric Discharge Particle Acceleration of Exogenous DNA into Immature Zygotic Embryos" Nat Biotechnol 9, 1991, 957-962 & 4462.

Citorik et al., "Sequence-specific Antimicrobials Using Efficiently Delivered RNA-guided Nucleases" Nat Biotechnol. Nov. 2014;32(11):1141-5.

Cong et al., "Multiplex Genome Engineering Using CRISPR/Cas Systems" Science. Feb. 15, 2013;339(6121):819-23.

Craig "Transposon Tn7" Curr Top Microbiol Immunol. 1996;204:27-48.

Chen "CRISPR/Cas Genome Editing and Precision Plant Breeding in Agriculture" Annual Review of Plant Biology vol. 70, 2019 Chen, pp. 667-697.

Daniell et al., "Containment of Herbicide Resistance Through Genetic Engineering of the Chloroplast Genome" Nat Biotechnol. Apr. 1998;16(4):345-8.

D'Halluin et al. "Transgenic Maize Plants by Tissue Electroporation" Plant Cell. Dec. 1992;4(12):1495-505.

Dicarlo et al., "Genome Engineering in *Saccharomyces cerevisiae* Using CRISPR-Cas Systems" Nucleic Acids Res. Apr. 2013;41(7):4336-43.

Dimos et al., "Induced Pluripotent Stem Cells Generated From Patients With ALS Can Be Differentiated Into Motor Neurons" Science. Aug. 29, 2008;321(5893):1218-21.

Dobosy et al., "RNase H-dependent PCR (rhPCR): Improved Specificity and Single Nucleotide Polymorphism Detection Using Blocked Cleavable Primers" BMC Biotechnol. Aug. 10, 2011;11:80. 18 pages.

Doudna et al., "Genome Editing. The New Frontier of Genome Engineering With CRISPR-Cas9" Science. Nov. 28, 2014;346(6213):1258096. 10 pages.

Eyquem et al., "Targeting a CAR to the TRAC Locus With CRISPR/Cas9 Enhances Tumour Rejection" Nature. Mar. 2, 2017;543(7643):113-117.

Fraley et al., "Expression of Bacterial Genes in Plant Cells" Proc Natl Acad Sci U S A. Aug. 1983;80(15):4803-7.

Friedensohn et al., "Advanced Methodologies in High-Throughput Sequencing of Immune Repertoires" Trends Biotechnol. Mar. 2017;35(3):203-214.

Fromm et al., "Expression of Genes Transferred Into Monocot and Dicot Plant Cells by Electroporation" Proc Natl Acad Sci U S A. Sep. 1985;82(17):5824-8.

Datta, A. Genetic engineering for improving quality and productivity of crops. Agric & Food Secur 2, 15 (2013), 3 pages.

Geurts et al., "Knockout Rats via Embryo Microinjection of Zinc-Finger Nucleases" Science. Jul. 24, 2009;325(5939):433.

Gordon-Kamm et al., "Transformation of Maize Cells and Regeneration of Fertile Transgenic Plants" Plant Cell. Jul. 1990;2(7):603-618.

Gould et al., "Transformation of *Zea mays* L. Using Agrobacterium Tumefaciens and the Shoot Apex" Plant Physiol. Feb. 1991;95(2):426-34.

Gratz et al., "Genome Engineering of *Drosophila* With the CRISPR RNA-guided Cas9 Nuclease" Genetics. Aug. 2013;194(4):1029-35.

Grimsley et al., "Agrobacterium-mediated delivery of infectious maize streak virus into maize plants." (1987) Nature 325:1677-179.

Haapaniemi et al., "CRISPR-Cas9 Genome Editing Induces a p53-mediated DNA Damage Response" Nat Med. Jul. 2018;24(7):927-930.

Hagemann et al., "Tn7 Transposition Creates a Hotspot for Homologous Recombination at the Transposon Donor Site" Genetics. Jan. 1993;133(1):9-16.

Heidrich et al., "Investigating CRISPR RNA Biogenesis and Function Using RNA-seq" Methods Mol Biol. 2015;1311:1-21.

Heigwer et al., "E-CRISP: Fast CRISPR Target Site Identification" Nat Methods. Feb. 2014;11(2):122-3.

Hernalsteens et al., "An Agrobacterium-transformed Cell Culture From the Monocot Asparagus Officinalis" EMBO J. Dec. 20, 1984;3(13):3039-41.

Herrera-Estrella et al. Expression of chimaeric genes transferred into plant cells using a Ti-plasmid-derived vector (1983) Nature 303: 209-213.

Hille et al., "The Biology of CRISPR-Cas: Backward and Forward" Cell. Mar. 8, 2018;172(6):1239-1259.

Hooykass-Van Slogteren et al., "Expression of Ti plasmid genes in monocotyledonous plants infected with Agrobacterium tumefaciens" (1984) Nature 311:763-764.

Horsch et al., "Inheritance of Functional Foreign Genes in Plants" Science. Feb. 3, 1984;223(4635):496-8.

Horsch et al., "A Simple and General Method for Transferring Genes Into Plants" Science. Mar. 8, 1985;227(4691):1229-31.

Hou et al., "CRISPR-Cas systems in multicellular cyanobacteria" RNA Biol. Apr. 2019;16(4):518-529. d.

Husaini et al., "Approaches for Gene Targeting and Targeted Gene Expression in Plants" GM Crops. Jun.-Dec. 2011;2(3):150-62.

Hwang et al., "Efficient Genome Editing in Zebrafish Using a CRISPR-Cas System" Nat Biotechnol. Mar. 2013;31(3):227-9.

Ibraheem et al., "Gene Therapy and DNA Delivery Systems" Int J Pharm. Jan. 1, 2014;459(1-2):70-83.

Ihry et al., "p53 Inhibits CRISPR-Cas9 Engineering in Human Pluripotent Stem Cells" Nat Med. Jul. 2018;24(7):939-946.

Ishida et al., "High Efficiency Transformation of Maize (*Zea mays* L.) Mediated by Agrobacterium Tumefaciens" Nat Biotechnol. Jun. 1996;14(6):745-50.

Ivics et al., "Transposon-mediated Genome Manipulation in Vertebrates" Nat Methods. Jun. 2009;6(6):415-22.

Jiang et al., "RNA-guided Editing of Bacterial Genomes Using CRISPR-Cas Systems" Nat Biotechnol. Mar. 2013;31(3):233-9.

Jiang et al., "Demonstration of CRISPR/Cas9/sgRNA-mediated Targeted Gene Modification in *Arabidopsis*, Tobacco, Sorghum and Rice" Nucleic Acids Res. Nov. 2013;41(20):e188. 12 pages.

Jinek et al., "A Programmable dual-RNA-guided DNA Endonuclease in Adaptive Bacterial Immunity" Science. Aug. 17, 2012;337(6096):816-21.

Johns et al., "Metagenomic Mining of Regulatory Elements Enables Programmable Species-Selective Gene Expression" Nat Methods. May 2018;15(5):323-329.

June et al., "Chimeric Antigen Receptor Therapy" N Engl J Med. Jul. 5, 2018;379(1):64-73.

(56) References Cited

OTHER PUBLICATIONS

Kaeppler et al., "Silicon Carbide Fiber-Mediated DNA Delivery Into Plant Cells" Plant Cell Rep. Dec. 1990;9(8):415-8.
Kamps et al., "Next-Generation Sequencing in Oncology: Genetic Diagnosis, Risk Prediction and Cancer Classification" Int J Mol Sci. Jan. 31, 2017;18(2):308. 57 pages.
Kanca et al., "Gene Tagging Strategies to Assess Protein Expression, Localization, and Function in *Drosophila*" Genetics. Oct. 2017;207(2):389-412.
Kaufman et al., "Translational Efficiency of Polycistronic mRNAs and Their Utilization to Express Heterologous Genes in Mammalian Cells" EMBO J. Jan. 1987;6(1):187-93.
Kay et al., "Viral Vectors for Gene Therapy: The Art of Turning Infectious Agents Into Vehicles of Therapeutics" Nat Med. Jan. 2001;7(1):33-40.
Klee et al., "Vectors for Transformation of Higher Plants" Nat Biotechnol 3, 637-642 (1985).
Klee et al., "Agrobacterium-mediated plant transformation and its further applications to plant biology." Annual Review of Plant Physiology 38 (1987): 467-486.
Klein et al., "Transfer of Foreign Genes Into Intact Maize Cells With High-Velocity Microprojectiles" Proc Natl Acad Sci U S A. Jun. 1988;85(12):4305-9.
Klein et al. "High-velocity microprojectiles for delivering nucleic acids into living cells." Nature 327.6117 (1987): 70-73.
Knoblauch et al., "A Galinstan Expansion Femtosyringe for Microinjection of Eukaryotic Organelles and Prokaryotes" Nat Biotechnol. Sep. 1999;17(9):906-9.
Kosicki et al., "Repair of Double-Strand Breaks Induced by CRISPR-Cas9 Leads to Large Deletions and Complex Rearrangements" Nat Biotechnol. Sep. 2018;36(8):765-771.
Lee et al., "CRISPR-Cap: Multiplexed Double-Stranded DNA Enrichment Based on the CRISPR System" Nucleic Acids Res. Jan. 10, 2019;47(1):e1. 13 pages.
Li et al., "Design and specificity of long ssDNA donors for CRISPR-based knock-in" *BioRxiv*, 1-24 (2017).
Liu et al., "Systematic Comparison of 2A Peptides for Cloning Multi-Genes in a Polycistronic Vector" Sci Rep. May 19, 2017;7(1):2193. 9 pages.
Lu et al., "Isolation and Characterization of Tn7 Transposase Gain-Of-Function Mutants: A Model for Transposase Activation" EMBO J. Jul. 3, 2000;19(13):3446-57.
Luo et al., "Generation of Induced Pluripotent Stem Cells From Skin Fibroblasts of a Patient With Olivopontocerebellar Atrophy" Tohoku J Exp Med. Feb. 2012;226(2):151-9.
Makarova et al., "An Updated Evolutionary Classification of CRISPR-Cas Systems" Nat Rev Microbiol . Nov. 2015;13(11):722-36.
Makarova et al., "Classification and Nomenclature of CRISPR-Cas Systems: Where From Here?" CRISPR J. Oct. 2018;1(5):325-336.
Mali et al., "RNA-guided Human Genome Engineering via Cas9" Science. Feb. 15, 2013;339(6121):823-6.
Mamanova et al., "Target-enrichment Strategies for Next-Generation Sequencing" Nat Methods. Feb. 2010;7(2):111-8.
Manna et al., "Mu and IS1 transpositions exhibit strong orientation bias at the *Escherichia coli* bgl locus" J Bacteriol. Jun. 2001;183(11):3328-35.
Mashimo et al., "Generation of Knockout Rats With X-linked Severe Combined Immunodeficiency (X-SCID) Using Zinc-Finger Nucleases" PLoS One. Jan. 25, 2010;5(1):e8870. 17 pages.
May et al., "Switching From Cut- and -Paste to Replicative Tn7 Transposition" Science. Apr. 19, 1996;272(5260):401-4.
McBride et al., "Controlled Expression of Plastid Transgenes in Plants Based on a Nuclear DNA-encoded and Plastid-Targeted T7 RNA Polymerase" Proc Natl Acad Sci U S A. Jul. 19, 1994;91(15):7301-5.
McDonald et al., "CRISPR-Cas Systems Are Present Predominantly on Mobile Genetic Elements in *Vibrio* Species" BMC Genomics. Feb. 4, 2019;20(1):105. 23 pages.
Morrison et al., "Regulatory Mechanisms in Stem Cell Biology" Cell. Feb. 7, 1997;88(3):287-98.
Naldini et al., "Lentiviral Vectors, Two Decades Later" Science. Sep. 2016;353(6304):1101-2.
Blackham et al., "Stroke: The Vacuum Cleaner for Stroke" Nat Rev Neurol. Nov. 2009;5(11):582-3.
Nayersossadat et al., "Viral and Nonviral Delivery Systems for Gene Delivery" Adv Biomed Res. 2012;1:27.
Nicolas et al., "The Tn3-family of Replicative Transposons" Microbiology Spectrum. 2015;3(4) 32 pages.
Nishitani et al., "Efficient Genome Editing in Apple Using a CRISPR/Cas9 system" Sci Rep. Aug. 17, 2016;6:31481. 8 pages.
O'Neill et al., "Chloroplast Transformation in Plants: Polyethylene Glycol (PEG) Treatment of Protoplasts Is an Alternative to Biolistic Delivery Systems" Plant J. May 1993;3(5):729-38.
Paszowski et al., "Direct Gene Transfer to Plants" EMBO J. Dec. 1, 1984;3(12):2717-22.
Pawelczak et al., "Modulating DNA Repair Pathways to Improve Precision Genome Engineering" ACS Chem Biol. Feb. 16, 2018;13(2):389-396.
Peters et al., "Tn7: smarter than we thought" Nat Rev Mol Cell Biol. Nov. 2001;2(11):806-14.
Peters et al., "Heteromeric Transposase Elements: Generators of Genomic Islands Across Diverse Bacteria" Mol Microbiol. Sep. 2014;93(6):1084-92.
Peters "Tn7" Microbiol Spectr. Oct. 2014;2(5). 20 pages.
Peters et al., "Recruitment of CRISPR-Cas Systems by Tn7-like Transposons" Proc Natl Acad Sci U S A. Aug. 29, 2017;114(35):E7358-E7366.
Potrykus et al., "Molecular and General Genetics of a Hybrid Foreign Gene Introduced Into Tobacco by Direct Gene Transfer" Mol Gen Genet. 1985;199(2):169-77.
Prykhozhij et al., "CRISPR Multitargeter: A Web Tool to Find Common and Unique CRISPR Single Guide RNA Targets in a Set of Similar Sequences" PLoS One. Mar. 5, 2015;10(3):e0119372. 18 pages.
Qi et al., "Repurposing CRISPR as an RNA-guided Platform for Sequence-Specific Control of Gene Expression" Cell. Feb. 28, 2013;152(5):1173-83.
Barrangou et al., "Diversity of CRISPR-Cas Immune Systems and Molecular Machines" Genome Biol. Nov. 9, 2015;16:247.
Ran et al., "Genome Engineering Using the CRISPR-Cas9 System" Nat Protoc. Nov. 2013;8(11):2281-2308.
Reznikoff "Transposon Tn5" Annu Rev Genet. 2008;42:269-86.
Roberts et al., "Revised Nomenclature for Transposable Genetic Elements" Plasmid. Nov. 2008;60(3):167-73.
Rogers et al., "Gene transfer in plants: production of transformed plants using Ti plasmid vectors." Methods in enzymology. vol. 118. Academic Press, 1986. 627-640.
Ronda et al., "Metagenomic Engineering of the Mammalian Gut Microbiome in Situ" Nat Methods. Feb. 2019;16(2):167-170.
Ronning et al., "The Carboxy-Terminal Portion of TnsC Activates the Tn7 Transposase Through a Specific Interaction With TnsA" EMBO J. Aug. 4, 2004;23(15):2972-81.
Rosati et al., "Overview of Methodologies for T-cell Receptor Repertoire Analysis" BMC Biotechnol. Jul. 10, 2017;17(1):61. 16 pages.
San-Miguel et al., "Production of soluble eukaryotic recombinant proteins in *E. coli* is favoured in early log-phase cultures induced at low temperature" Springerplus. Dec. 2013;2(1):89. doi: 10.1186/2193-1801-2-89. 4 pages.
Shmakov et al., "Diversity and Evolution of Class 2 CRISPR-Cas Systems" Nat Rev Microbiol. Mar. 2017;15(3):169-182.
Seed "An LFA-3 cDNA Encodes a Phospholipid-Linked Membrane Protein Homologous to Its Receptor CD2" Nature. Oct. 29-Nov. 4, 1987;329(6142):840-2.
Shah et al., "Genome Editing in Plants: Advancing Crop Transformation and Overview of Tools" Plant Physiol Biochem. Oct. 2018;131:12-21.
Sharei et al., "A Vector-Free Microfluidic Platform for Intracellular Delivery" Proc Natl Acad Sci U S A. Feb. 5, 2013;110(6):2082-7.
Shevechenko et al., "In-gel Digestion for Mass Spectrometric Characterization of Proteins and Proteomes" Nat Protoc. 2006;1(6):2856-60.

(56) References Cited

OTHER PUBLICATIONS

Shimamoto et al., "Fertile transgenic rice plants regenerated from transformed protoplasts." Nature 338.6212 (1989): 274-276.
Slesarev et al., "CRISPR/CAS9 Targeted CAPTURE of Mammalian Genomic Regions for Characterization by NGS" Sci Rep. Mar. 5, 2019;9(1):3587.
Staub et al., "High-yield Production of a Human Therapeutic Protein in Tobacco Chloroplasts" Nat Biotechnol. Mar. 2000;18(3):333-8.
Strecker et al., "Engineering of CRISPR-Cas12b for Human Genome Editing" Nat Commun. Jan. 22, 2019;10(1):212.
Suwinski et al., "Advancing Personalized Medicine Through the Application of Whole Exome Sequencing and Big Data Analytics" Front Genet. Feb. 12, 2019;10:49.
Svab et al., "High-frequency Plastid Transformation in Tobacco by Selection for a Chimeric aadA Gene" Proc Natl Acad Sci U S A. Feb. 1, 1993;90(3):913-7.
Szpirer et al., "Mobilization Function of the pBHR1 Plasmid, a Derivative of the Broad-Host-Range Plasmid pBBR1" J Bacteriol. Mar. 2001;183(6):2101-10.
Tang et al., "Purification and Characterisation of the TnsB Protein of Tn7: A Transposition Protein That Binds to the Ends of Tn7" Nucleic Acids Res. Jun. 25, 1991;19(12):3395-402.
Tang et al., "Genetic Analysis of the Terminal 8-bp Inverted Repeats of Transposon Tn7" Gene. Aug. 30, 1995;162(1):41-6.
Tesson et al., "Knockout Rats Generated by Embryo Microinjection of TALENs" Nat Biotechnol. Aug. 5, 2011;29(8):695-6.
Visal et al. "Herbicide resistant fertile transgenic wheat plants obtained by microprojectile bombardment of regenerable embryogenic callus." Bio/technology 10.6 (1992): 667-674.
Wade-Martins "Developing Extrachromosomal Gene Expression Vector Technologies: An Overview" Methods Mol Biol. 2011;738:1-17.
Walther et al., "Viral Vectors for Gene Transfer: A Review of Their Use in the Treatment of Human Diseases" Drugs. Aug. 2000;60(2):249-71.
Wan et al., "Generation of Large Numbers of Independently Transformed Fertile Barley Plants" Plant Physiol. Jan. 1994;104(1):37-48.
Warr et al., "Exome Sequencing: Current and Future Perspectives" G3 (Bethesda). Jul. 2, 2015;5(8):1543-50.
Weeks et al., "Rapid Production of Multiple Independent Lines of Fertile Transgenic Wheat (*Triticum aestivum*)" Plant Physiol. Aug. 1993;102(4):1077-1084.
Wiedenheft et al., "RNA-guided Genetic Silencing Systems in Bacteria and Archaea" Nature. Feb. 15, 2012;482(7385):331-8.
Wiedenheft et al., "RNA-guided Complex From a Bacterial Immune System Enhances Target Recognition Through Seed Sequence Interactions" Proc Natl Acad Sci U S A. Jun. 21, 2011;108(25):10092-7.
Xiao et al., "CasOT: A Genome-Wide Cas9/gRNA Off-Target Searching Tool" Bioinformatics. Apr. 15, 2014;30(8):1180-1182.
Yamamoto et al., "Making ends meet: targeted integration of DNA fragments by genome editing" Chromosoma. Dec. 2018;127(4):405-420.
Yan et al., "Study of in Vitro Transcriptional Binding Effects and Noise Using Constitutive Promoters Combined With UP Element Sequences in *Escherichia coli*" J Biol Eng. Nov. 1, 2017;11:33. 11 pages.
Yosef et al., "Temperate and Lytic Bacteriophages Programmed to Sensitize and Kill Antibiotic-Resistant Bacteria" Proc Natl Acad Sci U S A. Jun. 9, 2015;112(23):7267-72.
Zhu et al., "Persistent Cellular Motion Control and Trapping Using Mechanotactic Signaling" PLoS One. Sep. 10, 2014;9(9):e105406. 9 pages.
Zhu et al., "Overview of guide RNA design tools for CRISPR-Cas9 genome editing technology." Frontiers in Biology 10.4 (2015): 289-296.
Cameron et al., "Harnessing Type I CRISPR-Cas Systems for Genome Engineering in Human Cells" Nat Biotechnol. Dec. 2019;37(12):1471-1477.
Zhu et al., "Shooting the Messenger: RNA-targetting CRISPR-Cas Systems" Biosci Rep. Jun. 21, 2018;38(3):BSR20170788.
Klompe et al., "Harnessing "A Billion Years of Experimentation": The Ongoing Exploration and Exploitation of CRISPR-Cas Immune Systems" CRISPR J. Apr. 2018;1(2):141-158.
Hou et al., "Inserting DNA With CRISPR" Science. Jul. 5, 2019;365(6448):25-26.
Strecker et al., "RNA-guided DNA Insertion With CRISPR-associated Transposases" Science. Jul. 5, 2019;365(6448):48-53.
Will et a., "Day and Night: Metabolic Profiles and Evolutionary Relationships of Six Axenic Non-Marine Cyanobacteria" Genome Biol Evol. Jan. 1, 2019;11(1):270-294.
International Search Report of related PCT/US2020/021568, dated Jul. 28, 2020, 77 pages.
Klompe et al., "Transposon-encoded CRISPR-Cas Systems Direct RNA-guided DNA Integration" Nature. Jul. 2019;571(7764):219-225.
Halpin-Healy et al., "Structural Basis of DNA Targeting by a Transposon-Encoded CRISPR-Cas System" Nature. Jan. 2020;577(7789):271-274.
Halpin Healy et al., "Structural basis of DNA targeting by a 1transposon-encoded CRISPR-Cas system" 2019, 46 pages.
Sternberg et al., Pep Talk: "Transposon-encoded CRISPR-Cas systems direct RNA-guided DNA integration" The Protein Science Week, Jan. 20, 2020, 53 pages.
Chen et al., "Mechanistic Factors of RNA-guided DNA Integration in Bacteria" Harvard NCRC Poster, Jan. 26, 2020, 1 page.
Sternberg "Transposon-encoded CRISPR-Cas systems direct RNA-guided DNA integration" University of Madison, Feb. 14, 2020, 65 pages.
Chen et al., "Mechanistic Factors of RNA-guided DNA Integration in Bacteria" SURF Poster, Feb. 14, 2020, 1 page.
Hogan et al., "Tagged expression constructs alter RNA-guided DNA integration in *E. coli*" SURF poster, Feb. 14, 2020, 1 page.
Sternberg "Genome Engineering Using CRISPR Technology" Mount Sinai, Feb. 24, 2020, 53 pages.
Klompe "Transposon-encoded CRISPR-Cas systems direct RNA-guided DNA integration" NYAS meeting, Feb. 24, 2020, 13 pages.
Sternberg "Programmable Genome Engineering Using Crispr Technology" USCAP, Mar. 2, 2020, 55 pages.
Sternberg, Blake Wiedenheft Visit, Mar. 7, 2019, 35 pages.
Chen "Transposon-encoded CRISPR arrays for pooled library sequencing of DNA integration" UN 3500 presentation, Apr. 30, 2020, 16 pages.
Sternberg "Transposon-encoded CRISPR-Cas systems direct RNA-guided DNA integration" New York Genome Center, May 29, 2019, 41 pages.
Klompe "Transposon-encoded CRISPR-Cas systems direct RNA-guided DNA integration" CRISPR2019_Poster, Jun. 17, 2019, 1 page.
Sternberg "Transposon-encoded CRISPR-Cas systems direct RNA-guided DNA integration" CRISPR 2019—Québec, Canada, Jun. 18, 2019, 56 pages.
Klompe "Transposon-encoded CRISPR-Cas systems direct RNA-guided DNA integration" Deans Day Poster, Sep. 16, 2019, 1 page.
Klompe "Transposon-encoded CRISPR-Cas systems facilitate programmable DNA integration" CRISPR Technologies Conference, Sep. 16, 2019, 18 pages.
Sternberg "Transposon-encoded CRISPR-Cas systems direct RNA-guided DNA integration" Genome Integrity Discussion Group, Oct. 7, 2019, 53 pages.
Sternberg "Transposon-encoded CRISPR-Cas systems direct RNA-guided DNA integration" CSHL CRISPR Meeting, Oct. 11, 2019, 41 pages.
Chen et al., "Mechanistic Factors of RNA-guided DNA Integration in Bacteria" Rabi Symposium, Oct. 18, 2019, 1 page.
Vo "Sternberg collaboration" Meeting With Oxford Nanopore, Oct. 30, 2019, 11 pages.
Vo "Discussion Points" Meeting With Oxford Nanopore, Nov. 6, 2019, 9 pages.
Sternberg "Transposon-encoded CRISPR-Cas systems direct RNA-guided DNA integration" Johns Hopkins University, Nov. 7, 2019, 65 pages.

(56) References Cited

OTHER PUBLICATIONS

Sternberg "Rewriting the Code of Life with CRISPR Technology" Emeritus Professors in Columbia (EPIC), Nov. 12, 2019, 68 pages.
Sternberg "Transposon-encoded CRISPR-Cas systems direct RNA-guided DNA integration" RNA Therapeutics Institute, UMass Medical School, Nov. 19, 2019, 65 pages.
Sternberg "Transposon-encoded CRISPR-Cas systems direct RNA-guided DNA integration" Helmholtz Institute for RNA-based Infection Research Würzburg, Germany, Dec. 10, 2019, 65 pages.
Parks et al., "Tn7 Elements: Engendering Diversity From Chromosomes to Episomes" Plasmid. Jan. 2009;61(1):1-14.
Chaikind et al., "A Programmable Cas9-serine Recombinase Fusion Protein That Operates on DNA Sequences in Mammalian Cells" Nucleic Acids Res. Nov. 16, 2016;44(20):9758-9770.
Bhatt et al., "Targeted DNA Transposition in Vitro Using a dCas9-transposase Fusion Protein" Nucleic Acids Res. Sep. 5, 2019;47(15):8126-8135.
Chavez et al., "Site-Programmable Transposition: Shifting the Paradigm for CRISPR-Cas Systems" Mol Cell . Jul. 25, 2019;75(2):206-208.
Chen et al., "An Engineered Cas-Transposon System for Programmable and Site-Directed DNA Transpositions" CRISPR J. Dec. 2019;2(6):376-394.
Dimitriu et al., "Transposition: A CRISPR Way to Get Around" Curr Biol. Sep. 23, 2019;29(18):R886-R889.
Faure et al., "CRISPR-Cas in Mobile Genetic Elements: Counter-Defence and Beyond" Nat Rev Microbiol. Aug. 2019;17(8):513-525.
Hanasaki et al., "CRISPR/Transposon Gene Integration (CRITGI) Can Manage Gene Expression in a Retrotransposon-Dependent Manner" Sci Rep. Oct. 25, 2019;9(1):15300.
Peters et al., "Targeted Transposition With Tn7 Elements: Safe Sites, Mobile Plasmids, CRISPR/Cas and Beyond" Mol Microbiol. Dec. 2019;112(6):1635-1644.
Peters et al., "Recruitment of CRISPR-Cas systems by Tn7-like transposons" PNAS Early Edition, 2017, 13 pages.
Standage-Beier et al., "RNA-Guided Recombinase-Cas9 Fusion Targets Genomic DNA Deletion and Integration" CRISPR J. Aug. 2019;2(4):209-222.
Jia et al., "Structure-function Insights Into the Initial Step of DNA Integration by a CRISPR-Cas-Transposon Complex" Cell Res. Feb. 2020;30(2):182-184.
Li et al., "Cryo-EM Structure of a Type I-F CRISPR RNA Guided Surveillance Complex Bound to Transposition Protein TniQ" Cell Res. Feb. 2020;30(2):179-181.
Van Der Oost et al., "First Structural Insights Into CRISPR-Cas-guided DNA Transposition" Cell Res. Mar. 2020;30(3):193-194.
Wang et al., "Structural Basis of a Tn7-like Transposase Recruitment and DNA Loading to CRISPR-Cas Surveillance Complex" Cell Res. Feb. 2020;30(2):185-187.
Peters et al., "Recruitment of CRISPR-Cas Systems by Tn7-like Transposons" 2017, 40 pages.
A16z Podcast: Damage-free Genome Editing, webpage retrieved May 7, 2020. 1 page.
Bhatt et al., "Targeted DNA transposition using a dCas9-transposase fusion protein" 2019.
Chen et a., "An Engineered Cas-Transposon System for Programmable and Precise DNA Transpositions" Jun. 3, 2019, 35 pages.
Coronavirus information for patients and the CUIMC community. Retrieved May 7, 2020, from https://www.cuimc.columbia.edu/news/new-gene-editor-harnesses-jumping-genes-precise-dna-integration, 8 pages.
Coronavirus information for patients and the CUIMC community. Retrieved May 7, 2020, from https://www.cuimc.columbia.edu/news/first-images-upgraded-crispr-tool, 9 pages.
Gene editing is back in the spotlight, retrieved from https://www.economist.com/science-and-technology/2019/06/15/gene-editing-is-back-in-the-spotlight, 7 pages.
Jump around: How 'jumping genes' could transform gene editing, retrieved from https://news.yahoo.com/jump-around-jumping-genes-could-transform-gene-editing-170209347.html, 5 pages.
Irving "New CRISPR tool hijacks "jumping genes" for gentle DNA editing" retrieved from https://newatlas.com/medical/crispr-integrate-dna-editing/, 9 pages.
Jump around: How 'jumping genes' could transform gene editing, retrieved May 7, 2020, from, https://www.japantimes.co.jp/liveblogs/news/coronavirus-outbreak-updates/, 2 pages.
Lemieux "CRISPR Jumps in New Directions" CRISPR J. Dec. 2019;2(6):354-356.
CRISPR Jumps in New Direction, retrieved on May 7, 2020, from https://www.genengnews.com/wp-content/uploads/2018/08/Nov14_2014_BacterialComputer3046931801.jpg, 18 pages.
First images of new gene editing complex which could upgrade CRISPR, retrieved on May 7, 2020, from https://www.news-medical.net/news/20191219/Discovery-of-new-gene-editing-complex-could-help-upgrade-CRISPR.aspx, 11 pages.
Research deepens on using "jumping genes" in CRISPR therapy, retrieved May 7, 2020, from https://www.axios.com/research-deepens-on-using-jumping-genes-in-crispr-therapy-84b1eb94-8309-4c59-a6a6-0ae7cc4743a1.html, 9 pages.
Another team has used 'jumping genes' to upgrade CRISPR gene editing, retrieved May 7, 2020, retrieved from https://www.newscientist.com/article/2206452-another-team-has-used-jumping-genes-to-upgrade-crispr-gene-editing/, 4 pages.
CRISPR Leaps Forward with Jumping Gene Inserts, retrieved on May 7, 2020, from https://www.synthego.com/blog/transposon-crispr-jump, 12 pages.
Episode 67: Biohacking meets bureaucracy, and the latest twist in CRISPR world, Apple Podcasts Preview, retrieved May 7, 2020, from https://podcasts.apple.com/us/podcast/the-readout-loud/id1354473987?i=1000441421181, 1 page.
URNUV "A CRISPR gun for hire" Nature, Jul. 2019, 180-181.
Weintrab "A CRISPR alternative for editing genes without cutting" FierceBiotech retrieve May 7, 2020, fromhttps://www.fiercebiotech.com/research/a-crispr-alternative-for-editing-genes-without-cutting, 4 pages.
Expanding the CRISPR Toolbox, retrieved May 7, 2020, from ttps://www.genengnews.com/topics/genome-editing/expanding-the-crispr-toolbox/, 8 pages.
Zhang, Feng. "Exploration of Diverse Mobile Genetic Elements for Precision Genome Manipulation." Grant, National Institutes of Health; Project No. 5DP1HL141201-03. Accessible at: https://projectreporter.nih.gov/project_info_description.cfm?aid=9771530&icde=49916786&ddparam=&ddvalue=&ddsub=&cr=1&csb=default&cs=ASC&pball=, 1 page.
Peters, Joseph. "CRISPR/Cas-Directed Transposition in Tn7-Like Elements." Grant, National Institutes of Health; Project No. 1R01GM129118-01A1. Accessible at: https://projectreporter.nih.gov/project_info_description.cfm?aid=9818261&icde=49916863&ddparam=&ddvalue=&ddsub=&cr=1&csb=default&cs=ASC&pball=,1 page.
Maruyama et al., "Increasing the efficiency of precise genome editing with CRISPR-Cas9 by inhibition of nonhomologous end joining" Nat Biotechnol . May 2015;33(5):538-42.
Koonin et al., "Diversity, classification and evolution of CRISPR-Cas systems" Curr Opin Microbiol . Jun. 2017;37:67-78.
Joung et al., "TALENs: a widely applicable technology for targeted genome editing" Nat Rev Mol Cell Biol . Jan. 2013;14(1):49-55.
Craig "Tn7: a target site-specific transposon" Mol Microbiol. Nov. 1991;5(11):2569-73.
Izsvak et al., "Sleeping beauty transposition: biology and applications for molecular therapy" Mol Ther . Feb. 2004;9(2):147-56.

\* cited by examiner

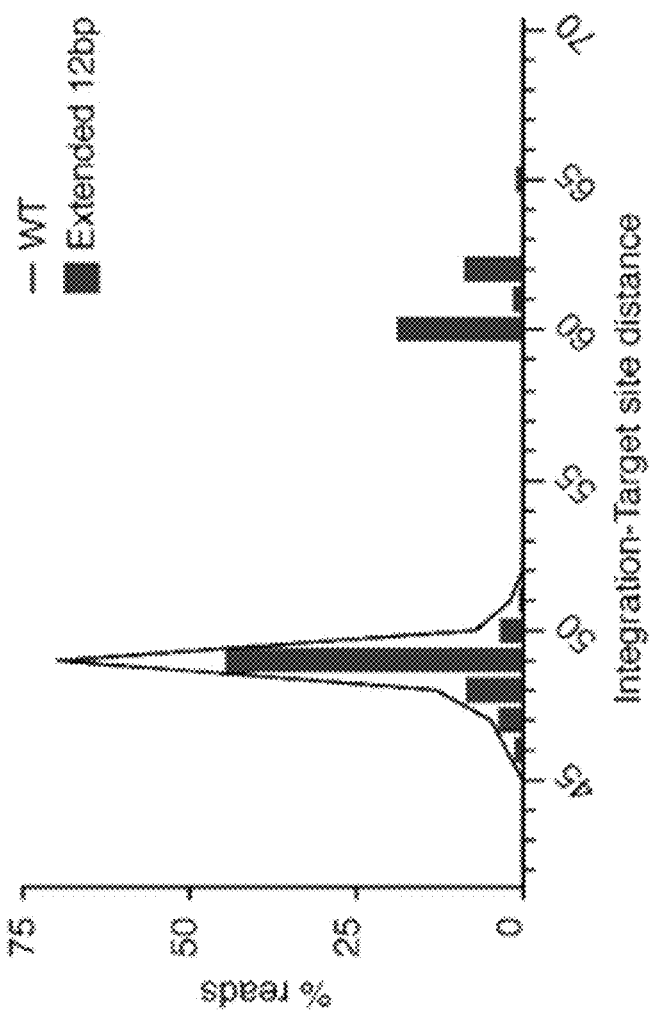
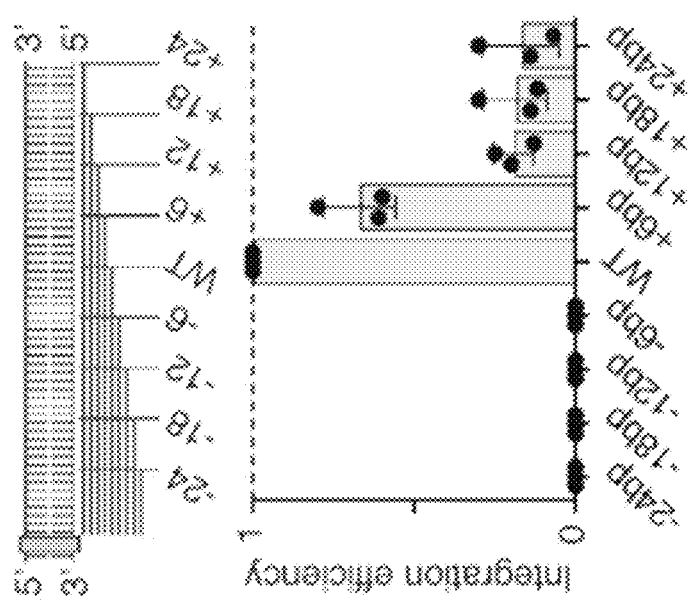
FIG. 3K gRNA-4

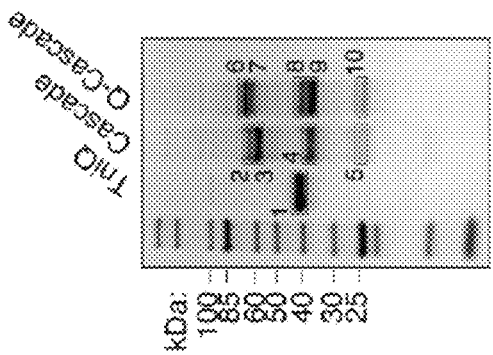
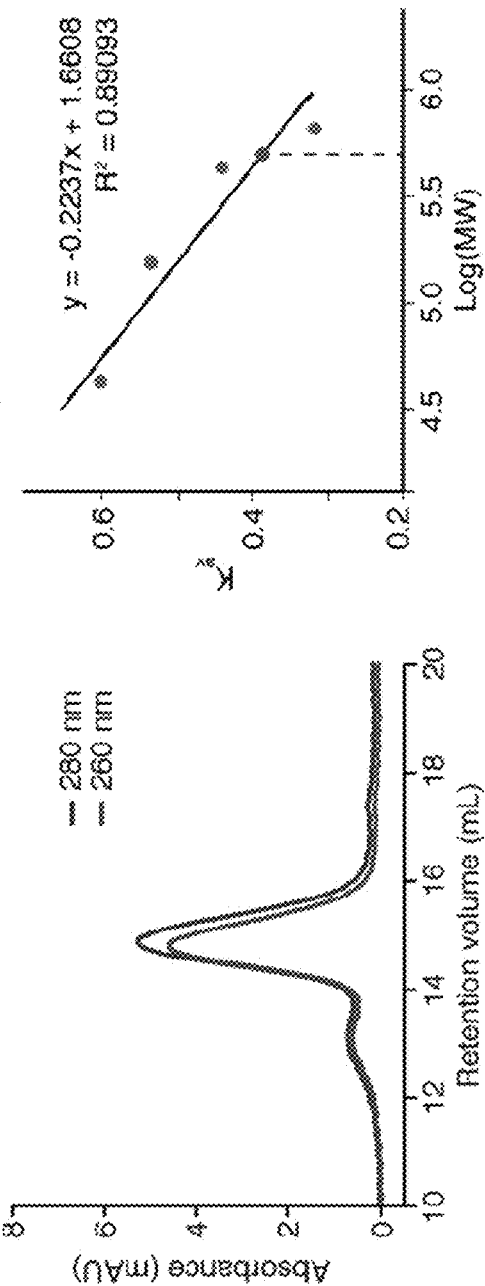
FIG. 8B
FIG. 8C

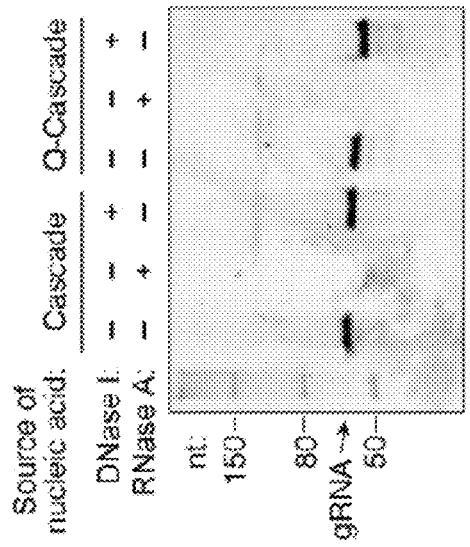
FIG. 8D
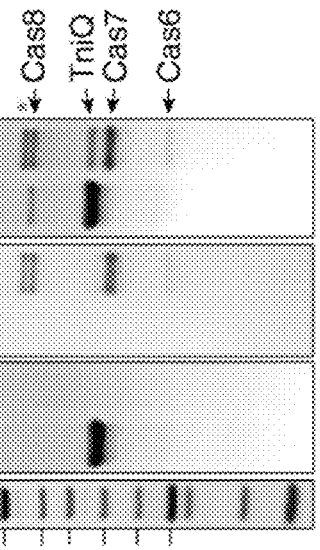
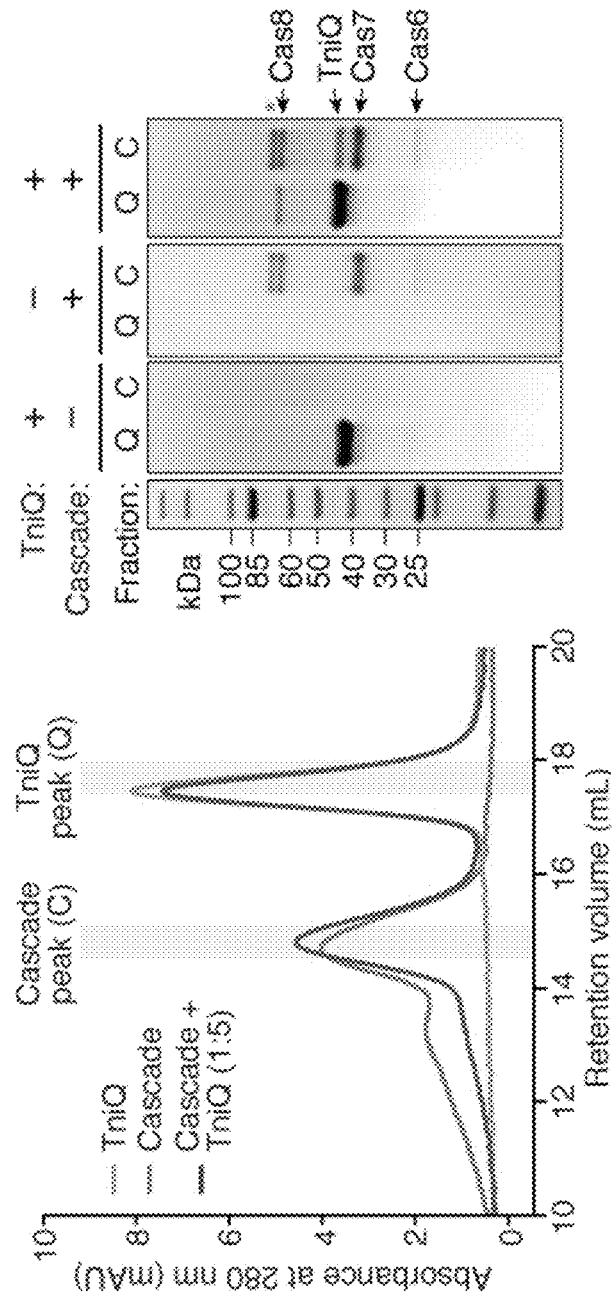
FIG. 8E

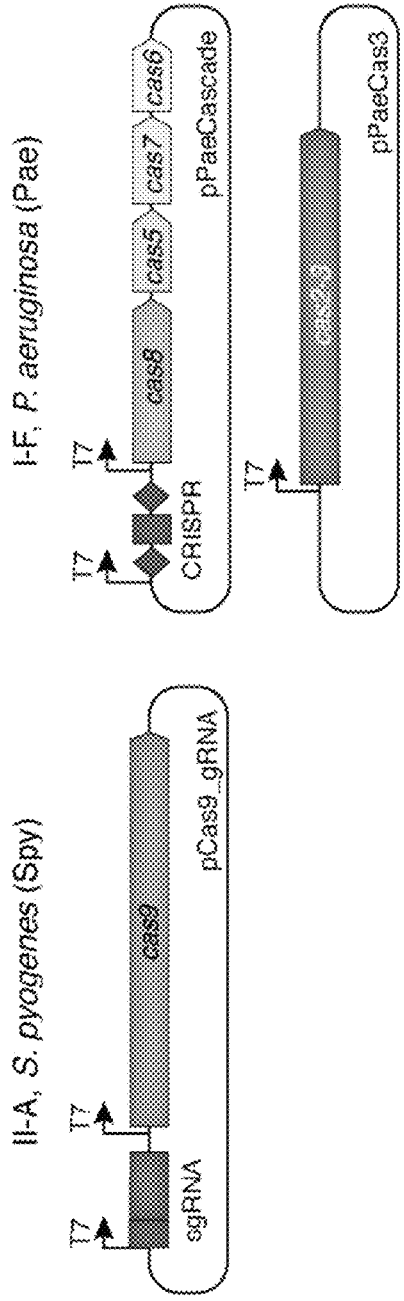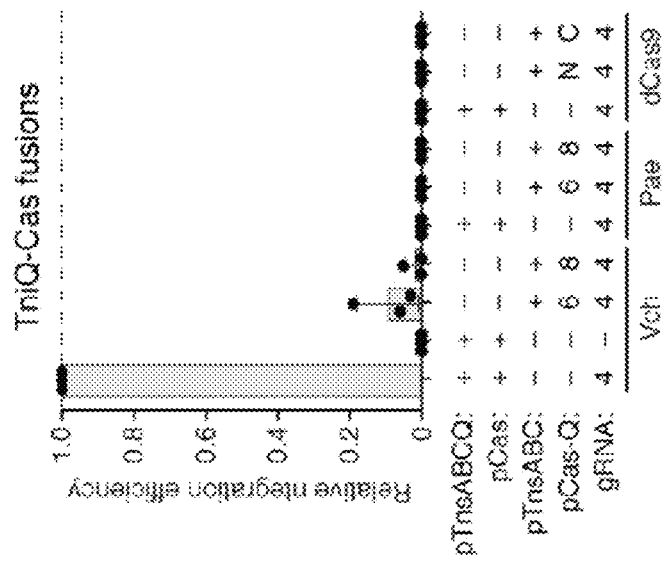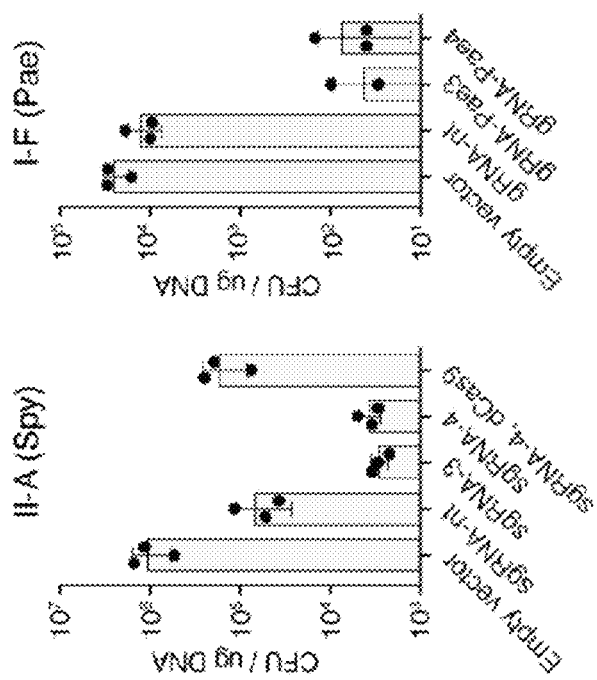
FIG. 9A
FIG. 9B
FIG. 9C

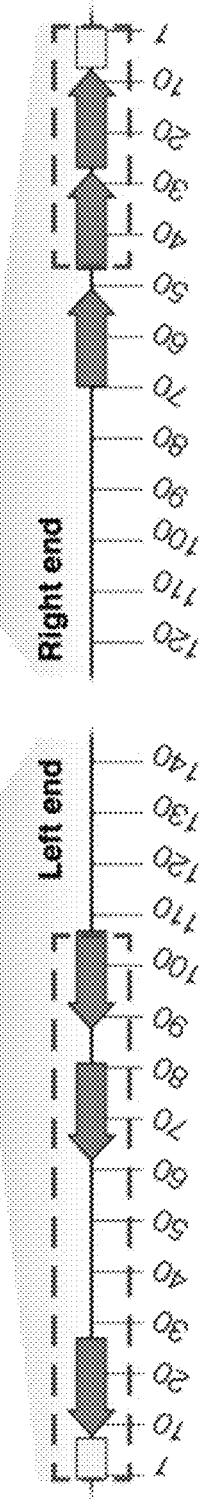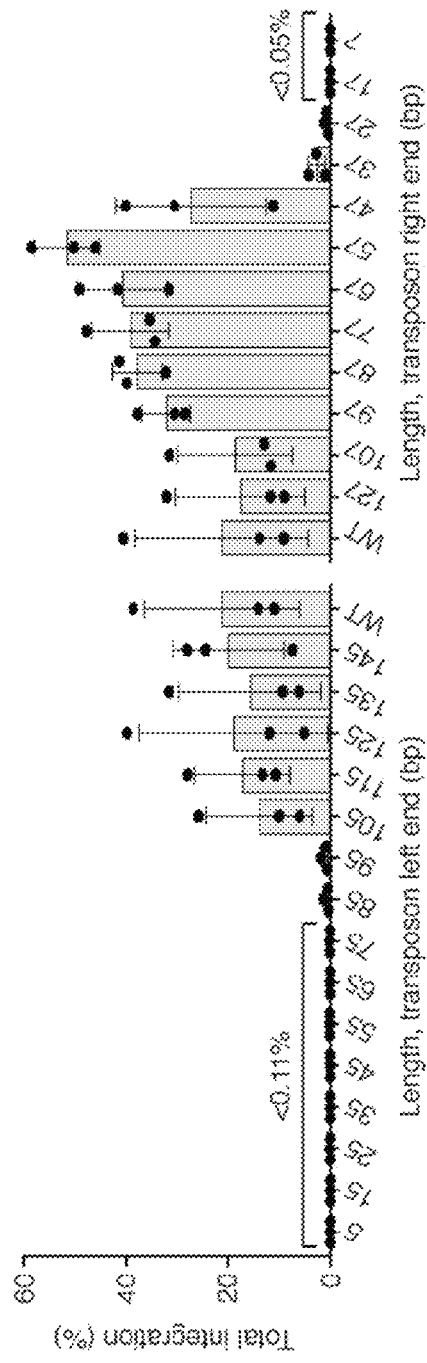
FIG. 11A
FIG. 11B

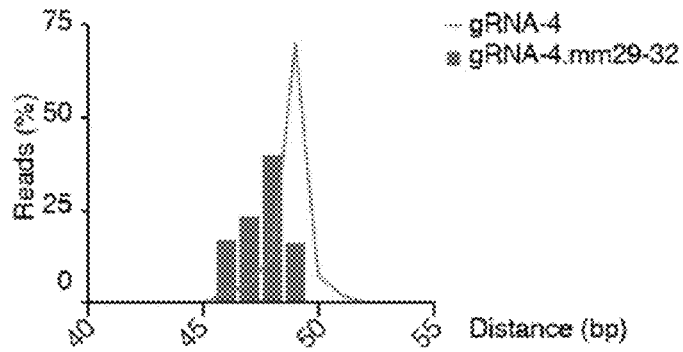
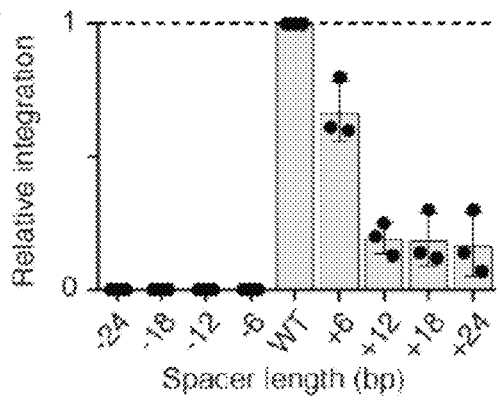
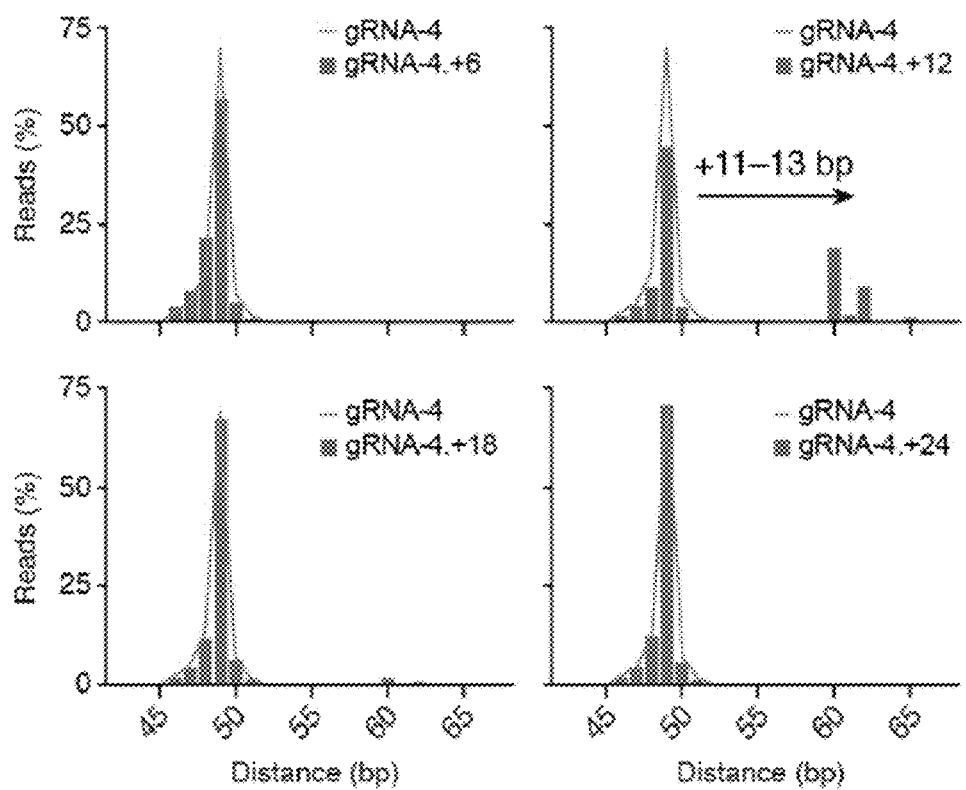
FIG. 12B
FIG. 12C
FIG. 12D

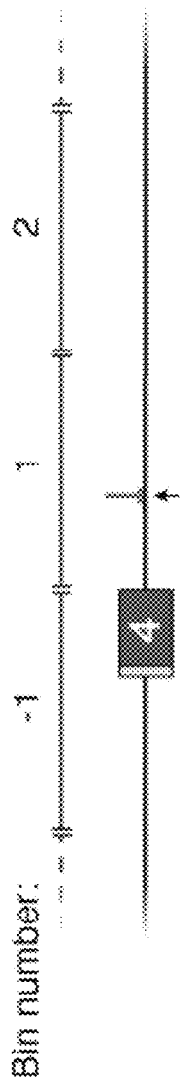
FIG. 13E
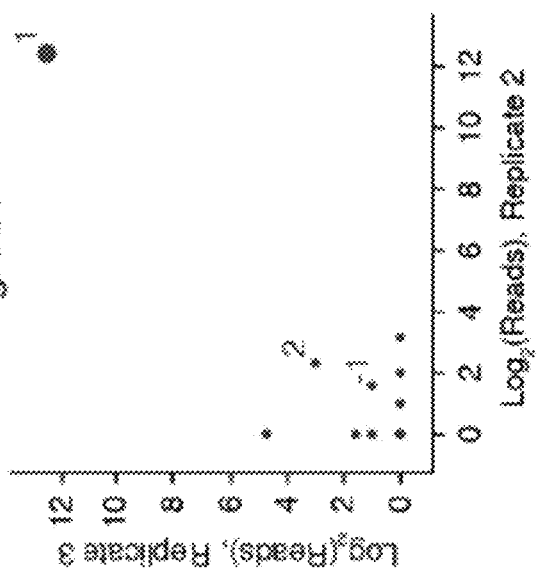
FIG. 13F
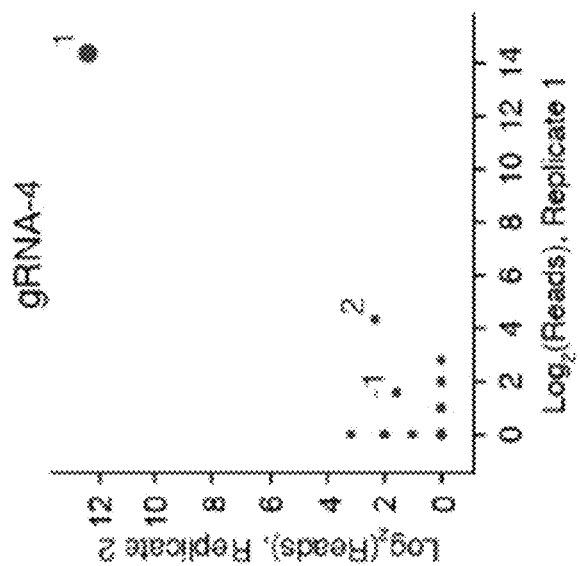

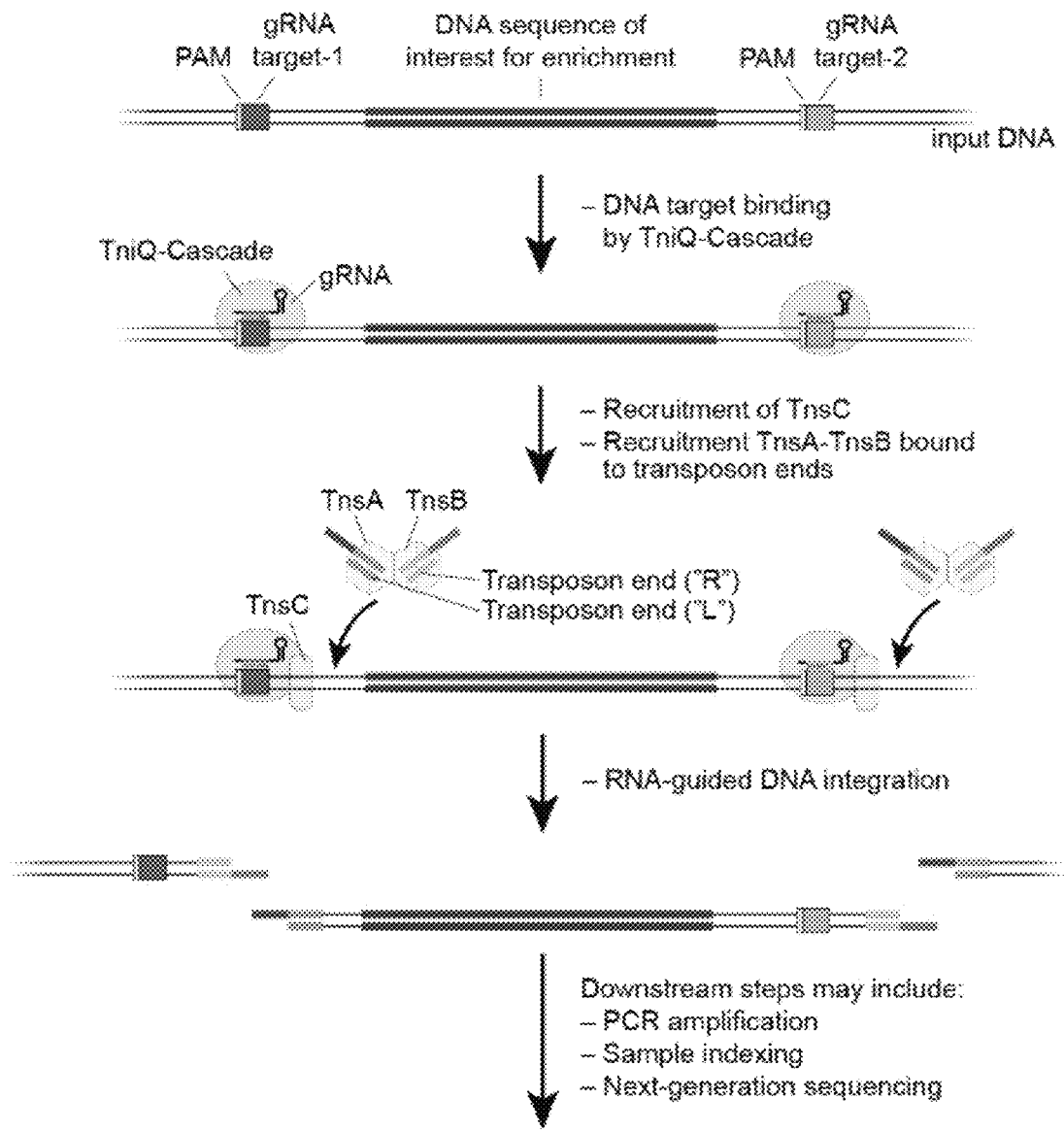
FIG. 33A
FIG. 33B

| Organism | NCBI Accession ID | WP_01 259624 6.1 | WP_01 259624 1.1 | WP_10 617327 7.1 | WP_06 611611 4.1 | WP_06 777223 8.1 | WP_09 655306 1.1 | WP_01 773997 9.1 | WP_01 211190 1.1 | WP_09 906741 6.1 | KIF355 41.1 |
|---|---|---|---|---|---|---|---|---|---|---|---|
| Cyan PCC 8801 | WP_012596246.1 | | 37 | 28 | 35 | 39 | 34 | 40 | 38 | 39 | 39 |
| Cyan PCC 8801 | WP_012596241.1 | 37 | | 28 | 42 | 49 | 36 | 47 | 45 | 47 | 46 |
| Filamentous CCP2 | WP_106173277.1 | 28 | 28 | | 27 | 32 | 29 | 31 | 32 | 31 | 31 |
| Gemino NIES-3709 | WP_066116114.1 | 35 | 42 | 27 | | 45 | 33 | 41 | 46 | 46 | 47 |
| Nostoc NIES-3756 | WP_067772238.1 | 39 | 49 | 32 | 45 | | 43 | 60 | 57 | 60 | 58 |
| Nostoc NIES-4103 | WP_096553061.1 | 34 | 36 | 29 | 33 | 43 | | 42 | 40 | 40 | 40 |
| Scyto PCC 7110 | WP_017739979.1 | 40 | 47 | 31 | 41 | 60 | 42 | | 54 | 57 | 55 |
| Nostoc punctiforme | WP_012411901.1 | 38 | 45 | 32 | 46 | 57 | 40 | 54 | | 65 | 84 |
| Nostoc linkia | WP_099067416.1 | 39 | 47 | 31 | 46 | 60 | 40 | 57 | 65 | | 66 |

FIG. 57A

| Organism | NCBI Accession ID | WP_01 259624 6.1 | WP_01 259624 1.1 | WP_10 617327 7.1 | WP_06 611611 4.1 | WP_06 777223 8.1 | WP_09 655306 1.1 | WP_01 773997 9.1 | WP_01 241190 1.1 | WP_09 906741 6.1 | KIF355 41.1 |
|---|---|---|---|---|---|---|---|---|---|---|---|
| Hassalia byssoidea | KIF35541.1 | 39 | 46 | 31 | 47 | 58 | 40 | 55 | 84 | 66 | |
| Ornaliun eppsanum 2.91 Mbp | WP_015203565.1 | 40 | 45 | 30 | 51 | 56 | 36 | 51 | 60 | 60 | 63 |
| Another Scytonema... not annotated | WP_096566883.1 | 34 | 35 | 29 | 34 | 43 | 70 | 44 | 41 | 41 | 41 |
| Leptolyngbya boryana NIES-2135 | WP_017289534.1 | 37 | 43 | 30 | 42 | 50 | 36 | 46 | 53 | 55 | 52 |
| Cyanobacterium aponinum IPPAS B-1201 | WP_099434943.1 | 37 | 42 | 27 | 46 | 46 | 34 | 45 | 51 | 50 | 52 |
| Leptolyngbya ohadii IS1 (no Tns genes) | WP_088893813.1 | 25 | 25 | 35 | 26 | 31 | 27 | 29 | 29 | 30 | 29 |
| Lyngbya confervoides BDU141951 | WP_039728122.1 | 30 | 29 | 38 | 30 | 30 | 34 | 32 | 32 | 30 | 32 |
| Cyanobacterium aponinum IPPAS B-1201 | WP_099436544.1 | 36 | 42 | 29 | 68 | 46 | 33 | 41 | 47 | 46 | 46 |
| Anabaena variabilis ATCC 29413 | ABA20755.1 | 39 | 45 | 30 | 46 | 61 | 40 | 55 | 65 | 87 | 66 |

FIG. 57B

| Organism | NCBI Accession ID | WP 01 259624 6.1 | WP 01 259624 1.1 | WP 10 617327 7.1 | WP 06 611611 4.1 | WP 06 777223 8.1 | WP 09 655306 1.1 | WP 01 773997 9.1 | WP 01 241190 1.1 | WP 09 906741 6.1 | KIF355 41.1 |
|---|---|---|---|---|---|---|---|---|---|---|---|
| Anabaena variabilis ATCC 29413 | ABA20947.1 | 39 | 49 | 32 | 44 | 91 | 44 | 60 | 57 | 61 | 59 |
| Anabaena variabilis ATCC 29413 | ABA21816.1 | 39 | 45 | 31 | 41 | 57 | 39 | 54 | 54 | 51 | 55 |
| Cyanothece sp. ATCC 51142 | ACB53128.1 | 43 | 49 | 29 | 52 | 58 | 44 | 54 | 63 | 60 | 64 |

FIG. 57C

| Organism | NCBI Accession ID | WP_0 152035 65.1 | WP_0 965668 83.1 | WP_0 172895 34.1 | WP_0 994349 43.1 | WP_0 888938 13.1 | WP_0 397281 22.1 | WP_0 994365 44.1 | ABA2 0785.1 | ABA2 0947.1 | ABA2 0947.1 | ACB5 3128.1 |
|---|---|---|---|---|---|---|---|---|---|---|---|---|
| Cyan PCC 8801 | WP_012596246.1 | 40 | 34 | 37 | 37 | 25 | 30 | 36 | 39 | 39 | 39 | 43 |
| Cyan PCC 8801 | WP_012596241.1 | 45 | 35 | 43 | 42 | 25 | 29 | 42 | 45 | 49 | 45 | 49 |
| Filamentous CCP2 | WP_106173277.1 | 30 | 29 | 30 | 27 | 35 | 38 | 29 | 30 | 32 | 31 | 29 |
| Gemino NIES-3709 | WP_066116114.1 | 51 | 34 | 42 | 46 | 26 | 30 | 68 | 46 | 44 | 41 | 52 |
| Nostoc NIES-3756 | WP_067772238.1 | 56 | 43 | 50 | 46 | 31 | 30 | 46 | 61 | 91 | 57 | 58 |
| Nostoc NIES-4103 | WP_096553061.1 | 36 | 70 | 36 | 34 | 27 | 34 | 33 | 40 | 44 | 39 | 44 |
| Scyto PCC 7110 | WP_017739979.1 | 51 | 44 | 46 | 45 | 29 | 32 | 41 | 55 | 60 | 54 | 54 |
| Nostoc punctiforme | WP_012411901.1 | 60 | 41 | 53 | 51 | 29 | 32 | 47 | 65 | 57 | 54 | 63 |
| Nostoc linckia | WP_099067416.1 | 60 | 41 | 55 | 50 | 30 | 30 | 46 | 87 | 61 | 51 | 60 |

FIG. 57D

| Organism | NCBI Accession ID | WP 0152035 65.1 | WP 0 965668 83.1 | WP 0 172895 34.1 | WP 0 994349 43.1 | WP 0 888938 13.1 | WP 0 397281 22.1 | WP 0 994365 44.1 | ABA2 0785.1 | ABA2 0947.1 | ABA2 0947.1 | ACB5 3128.1 |
|---|---|---|---|---|---|---|---|---|---|---|---|---|
| Hassallia byssoidea | KIF35541.1 | 63 | 41 | 52 | 52 | 29 | 32 | 46 | 66 | 59 | 55 | 64 |
| Ornatium epipsammum 2.91 Mbp | WP_015203565.1 | | 38 | 52 | 52 | 28 | 31 | 50 | 62 | 57 | 51 | 66 |
| Another Scytonema... not annotated | WP_096566883.1 | 38 | | 37 | 34 | 26 | 31 | 34 | 41 | 43 | 42 | 44 |
| Leptolyngbya boryana NIES-2135 | WP_017289534.1 | 52 | 37 | | 45 | 27 | 28 | 41 | 54 | 49 | 47 | 54 |
| Cyanothecium aponinum IPPAS B-1201 | WP_099434943.1 | 52 | 34 | 45 | | 25 | 28 | 46 | 48 | 46 | 45 | 55 |
| Leptolyngbya ohadii IS1 (no Tns genes) | WP_088893813.1 | 28 | 26 | 27 | 25 | | 34 | 26 | 30 | 32 | 29 | 28 |
| Lyngbya confervoides BDU141951 | WP_039728122.1 | 31 | 31 | 28 | 28 | 34 | | 30 | 29 | 32 | 31 | 30 |
| Cyanobacterium aponinum IPPAS B-1201 | WP_099436544.1 | 50 | 34 | 41 | 46 | 26 | 30 | | 46 | 44 | 40 | 52 |
| Anabaena variabilis ATCC 29413 | ABA20785.1 | 62 | 41 | 54 | 48 | 30 | 29 | 46 | | 61 | 52 | 63 |

FIG. 57E

| Organism | NCBI Accession ID | WP_0152035 65.1 | WP_0965668 83.1 | WP_0172895 34.1 | WP_0994349 43.1 | WP_0888938 13.1 | WP_0397281 22.1 | WP_0994365 44.1 | ABA2 0785.1 | ABA2 0947.1 | ABA2 0947.1 | ACB5 3128.1 |
|---|---|---|---|---|---|---|---|---|---|---|---|---|
| Anabaena variabilis ATCC 29413 | ABA20947.1 | 57 | 43 | 49 | 46 | 32 | 32 | 44 | 61 | | 57 | 57 |
| Anabaena variabilis ATCC 29413 | ABA21816.1 | 51 | 42 | 47 | 45 | 29 | 31 | 40 | 52 | 57 | | 55 |
| Cyanothece sp. ATCC 51142 | ACB53128.1 | 66 | 44 | 54 | 55 | 28 | 30 | 52 | 63 | 57 | 55 | |

FIG. 57F

| Organism | NCBI Accession ID | CRISPR length | C2c5 length | tRNA | MerR | Cargo | Tns length | Additional Information |
|---|---|---|---|---|---|---|---|---|
| Cyan PCC 8801 | WP_012596246.1 | 4 repeats | 1983 | tRNA Pro | no | Single gene, AAA+ | 3438 | Immediately flanking TnsBCD operon |
| Cyan PCC 8801 | WP_012596241.1 | 5 repeats | 2049 | no | no; has CopG-like ribbon-helix-helix domain | RM system, transposase, HNH endonuclease | 3082 | Flanked on other side by Tns operon from a separate transposon-C2c5 complex. |
| Filamentous CCP2 | WP_106173277.1 | 4 repeats | 2268 | tRNA Ala | no; has CopG-like ribbon-helix-helix domain | PatB/HNH, hypotheticals, NACHT domain | 3460 | |
| Gemino NIES-3709 | WP_066116114.1 | 5 repeats | 1851 | tRNA Arg | yes | alkyl sulfatase | 2987 | Cargo looks like not defense-associated |
| Nostoc NIES-3756 | WP_067772238.1 | 5 repeats | 1908 | tRNA Ala | no | R-M system, peptidase/cell wall associated | 3223 | |
| Nostoc NIES-4103 | WP_096553061.1 | 3 repeats | 1998 | no | no; has CopG-like ribbon-helix-helix domain | No cargo in between C2c5 and Tns | 3161 | Tns operon orientation, relative to C2c5, is atypical |
| Scyto PCC 7110 | WP_017739979.1 | 15 repeats | 1938 | no | | NACHT, WD40 protein, ATPase | 3232 | |

FIG. 58A

| Organism | NCBI Accession ID | CRISPR length | C2c5 length | tRNA | MerR | Cargo | Tns length | Additional Information |
|---|---|---|---|---|---|---|---|---|
| Nostoc punctiforme | WP_012411901.1 | 13 repeats | 1920 | tRNA Val | yes | BREX system | 3089 | |
| Nostoc linckia | WP_099067416.1 | 15-20 repeats | 1938 | no | yes | R-M system, NACHT domain | 3038 | |
| Hassallia byssoidea | KIF38541.1 | 7 repeats | 1920 | tRNA Leu | yes | R-M system, Piwi | 3092 | |
| Crinalium epipsammum 2.91 Mbp | WP_015203565.1 | 2 repeats | 1845 | tRNA Lys | yes | R-M system, PIN domain, transposase, histidine-like kinase | 3001 | |
| Another Scytonema... not annotated | WP_096566883.1 | -- | N/A | N/A | N/A | N/A | N/A | N/A |
| Leptolyngbya boryana NIES-2135 | WP_017289534.1 | -- | N/A | N/A | N/A | N/A | N/A | N/A |
| Cyanobacterium aponinum PPAS B-1201 | WP_099434943.1 | 4 repeats | 1839 | tRNA Pro | yes | R-M system; phage-associated protein | 3216 | |
| Leptolyngbya ohadii IS1 (no Tns genes) | WP_088893813.1 | -- | N/A | N/A | N/A | N/A | N/A | No Tns genes |

FIG. 58B

| Organism | NCBI Accession ID | CRISPR length | C2c5 length | tRNA | MerR | Cargo | Tns length | Additional Information |
|---|---|---|---|---|---|---|---|---|
| Lyngbya confervoides BDU141951 | WP_039728122.1 | 3 repeats | 1590 | no | no | DNA phosphoro-thioation system; transposase | 3291 | |
| Cyanobacterium aponinum PPCAS B-1201 | WP_099436544.1 | 9 repeats | 1872 | tRNA Arg | yes | R-M module | 3006 | |
| Anabaena variabilis ATCC 29413 | ABA20785.1 | 3 repeats | 1929 | tRNA Pro | yes | R-M module, ser-thr protein kinase | 3026 | |
| Anabaena variabilis ATCC 29413 | ABA20947.1 | 3 repeats | 1908 | no | no | R-M system, ATPase | 4703 | Orientation of Tns operon is backwards compared to C2c5 and other systems |
| Anabaena variabilis ATCC 29413 | ABA21816.1 | 4 repeats | 1932 | tRNA Thr | transcriptional regulator, XRE family | R-M like, ATPase | 3783 | |
| Cyanothece sp. ATCC 51142 | ACB53128.1 | 3 repeats | 1005, possibly truncated | | | | | |

FIG. 58C

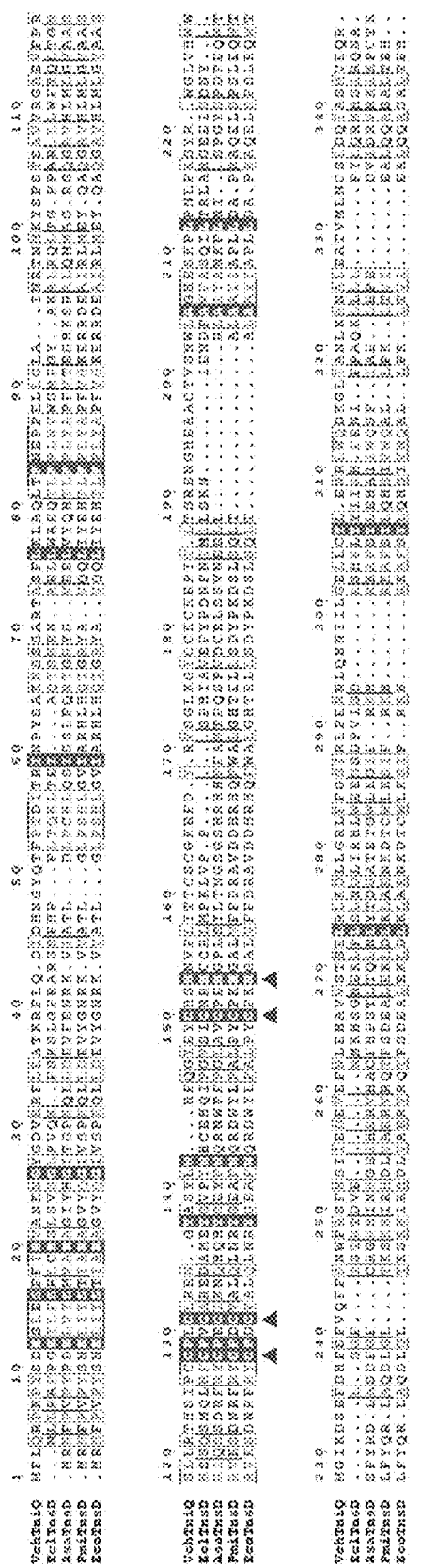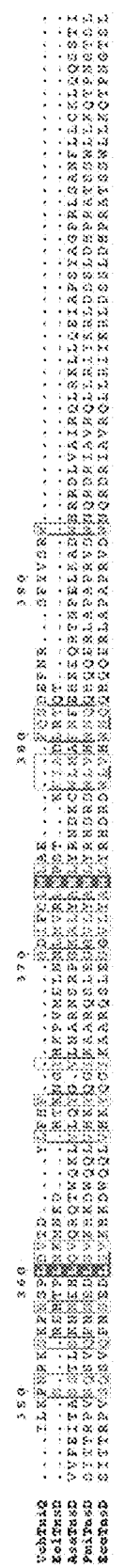
FIG. 62
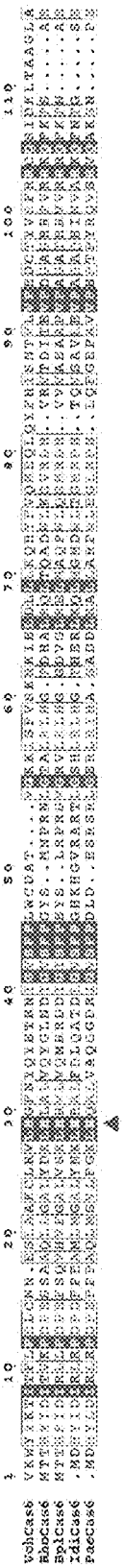
FIG. 63

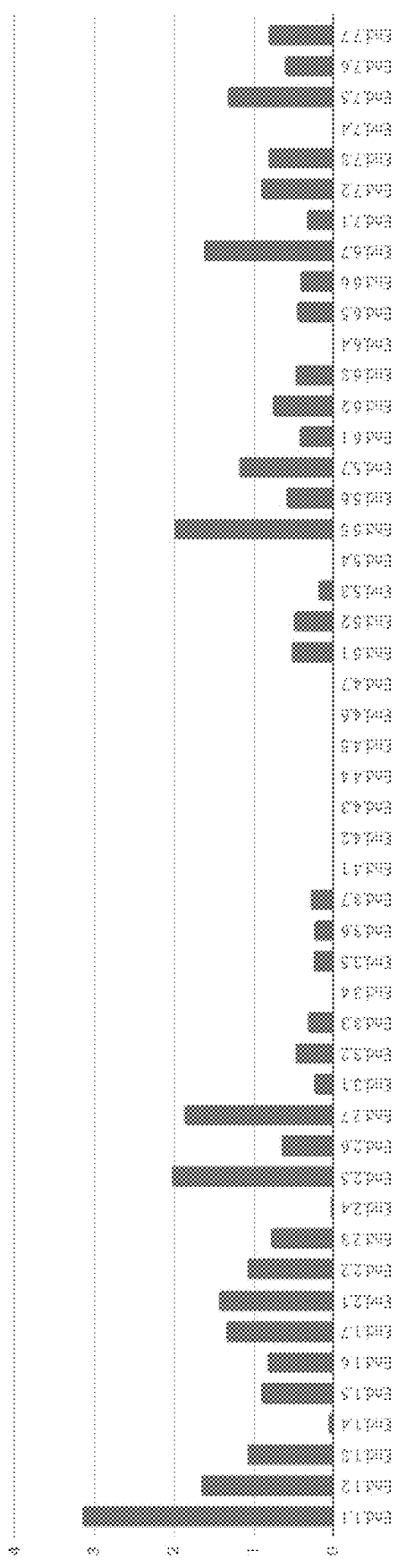
FIG. 72

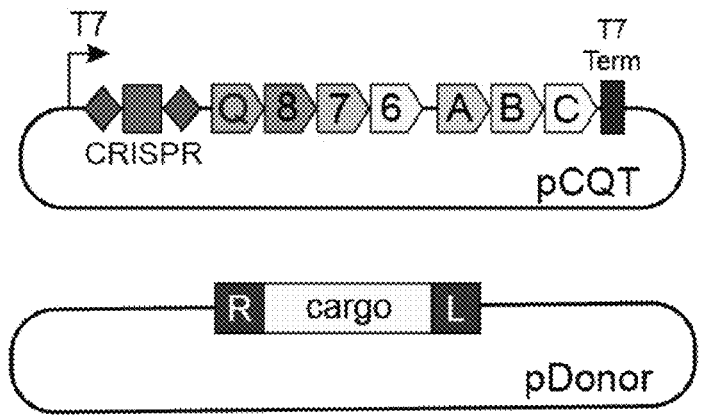

FIG. 80A

| Organism ID | pCQT (crRNA-4) | pDonor |
|---|---|---|
| *Vibrio cholerae* strain HE-45 | pSL1022 (SEQ ID NO: 855) | pSL1235 (SEQ ID NO: 1614) |
| *Vibrio cholerae* strain 4874 | pSL1781 (SEQ ID NO: 1623) | pSL1711 (SEQ ID NO: 1615) |
| *Photobacterium iliopiscarium* strain NCIMB | pSL1782 (SEQ ID NO: 1624) | pSL1712 (SEQ ID NO: 1616) |
| *Pseudoalteromonas* sp. P1-25 | pSL1783 (SEQ ID NO: 1625) | pSL1713 (SEQ ID NO: 1617) |
| *Pseudoalteromonas ruthenica* strain S3245 | pSL1784 (SEQ ID NO: 1626) | pSL1714 (SEQ ID NO: 1618) |
| *Photobacterium ganghwense* strain JCM | pSL1785 (SEQ ID NO: 1627) | pSL1715 (SEQ ID NO: 1619) |
| *Shewanella* sp. UCD-KL21 | pSL1786 (SEQ ID NO: 1628) | pSL1716 (SEQ ID NO: 1620) |
| *Vibrio diazotrophicus* strain 60.6F | pSL1787 (SEQ ID NO: 1903) | pSL1717 (SEQ ID NO: 1897) |
| *Vibrio cholerae* strain OYP7G04 | pSL1788 (SEQ ID NO: 1629) | pSL1718 (SEQ ID NO: 1621) |
| *Vibrio* sp. 16 | pSL1789 (SEQ ID NO:1904) | pSL1719 (SEQ ID NO: 1898) |
| *Vibrio* sp. F12 | pSL1790 (SEQ ID NO:1905) | pSL1720 (SEQ ID NO: 1899) |
| *Vibrio cholerae* strain M1517 | pSL1792 (SEQ ID NO: 1630) | pSL1722 (SEQ ID NO: 1622) |
| *Vibrio splendidus* strain UCD-SED10 | pSL1793 (SEQ ID NO: 1906) | pSL1723 (SEQ ID NO: 1900) |
| *Aliivibrio wodanis* 06/06/160 | pSL1794 (SEQ ID NO: 1907) | pSL1724 (SEQ ID NO: 1901) |
| *Parashewanella spongiae* strain HJ039 | pSL1795 (SEQ ID NO: 1908) | pSL1725 (SEQ ID NO: 1902) |

FIG. 80B

*Scytonema hofmannii* strain PCC 7110

|  | plasmid ID |
|---|---|
| pAIO (NT/cloning) | pSL1117 |
| pCQT (NT/cloning) | pSL1114 |
| pDonor (2kb transposon) | pSL0948 |

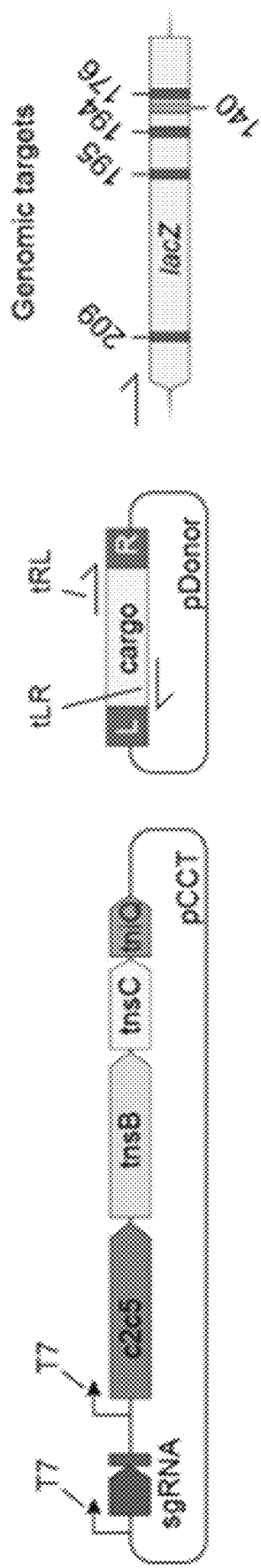
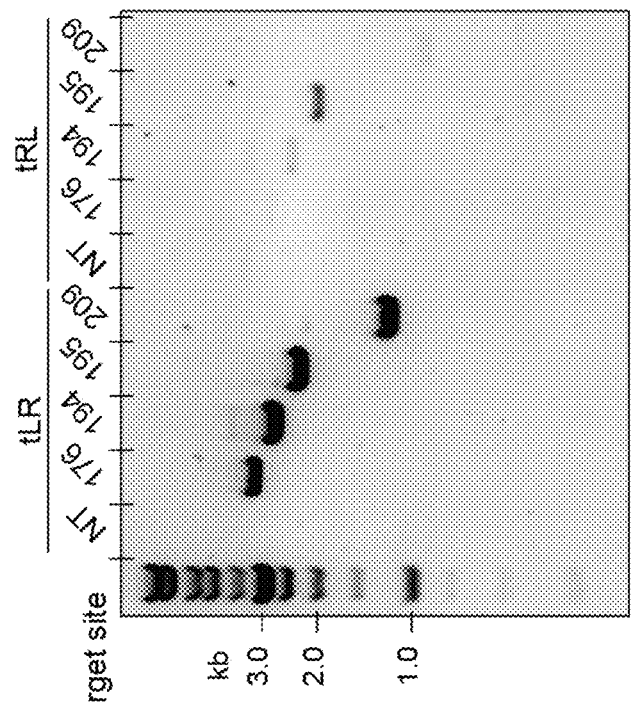
FIG. 84A
FIG. 84B

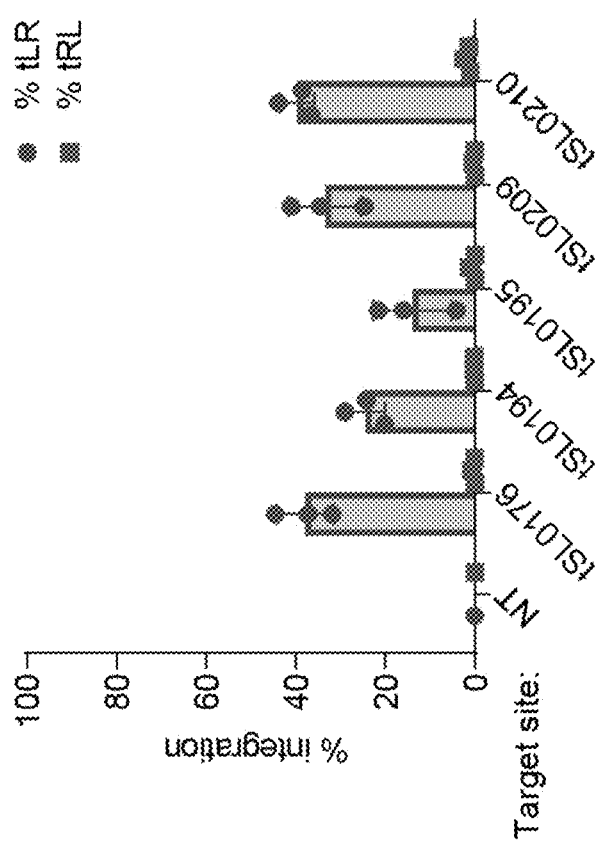
FIG. 84C
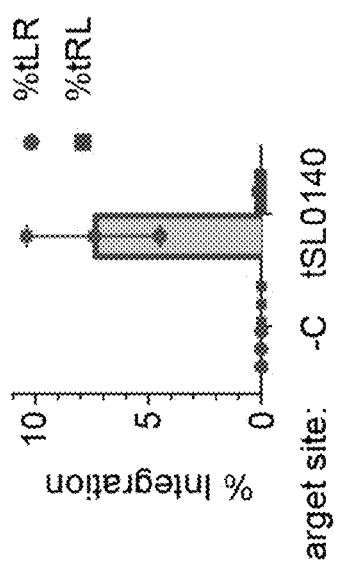
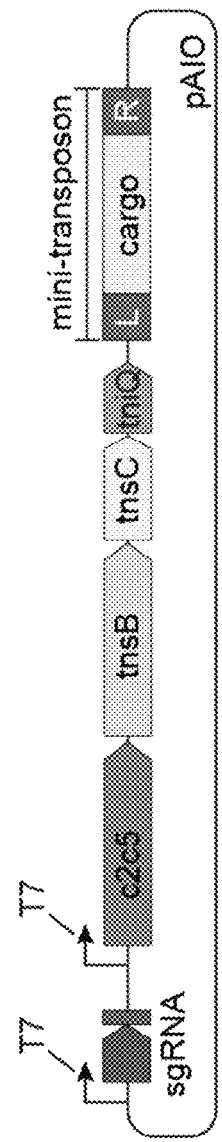
FIG. 84D

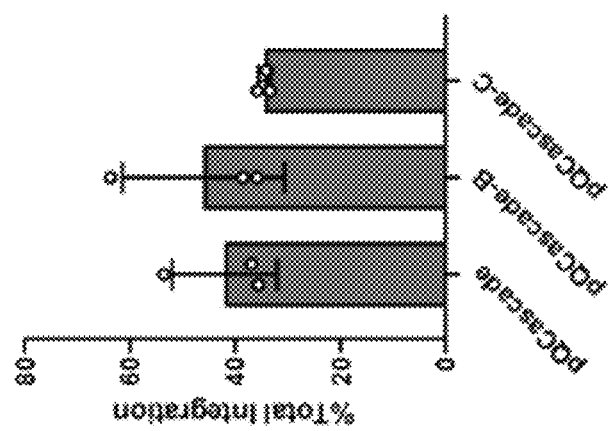
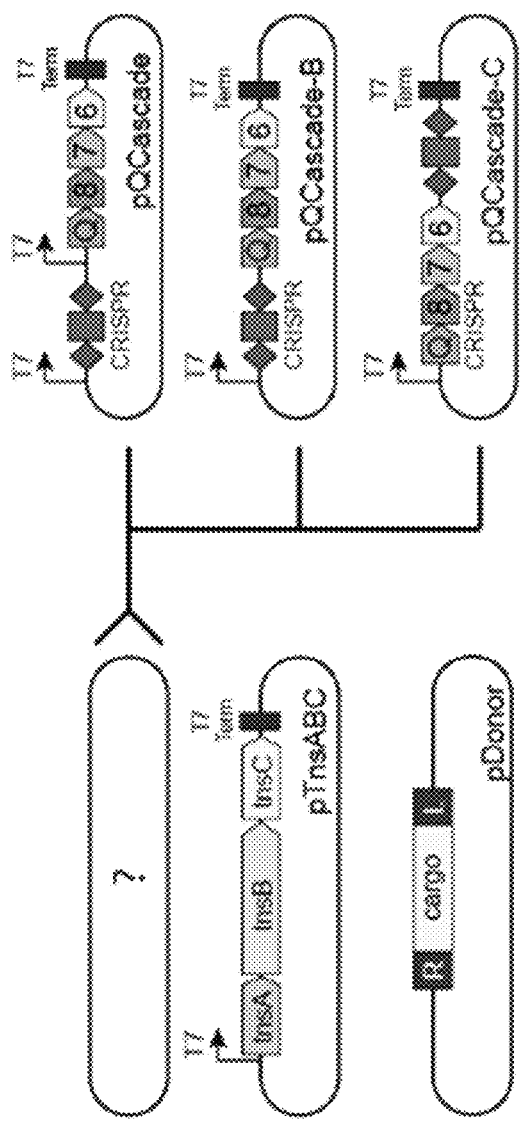
FIG. 87A

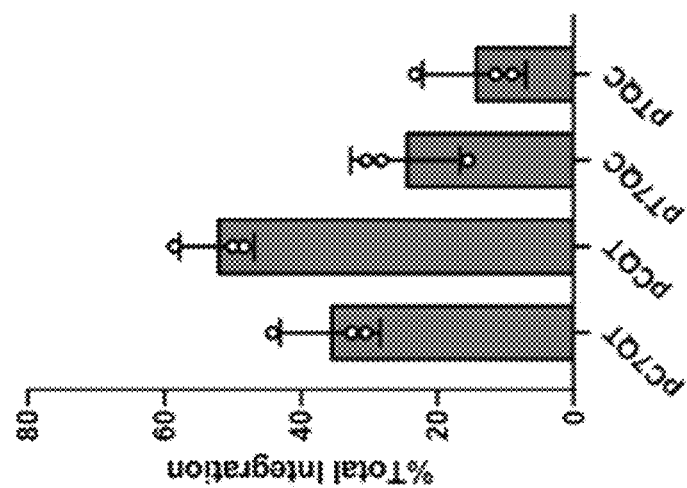
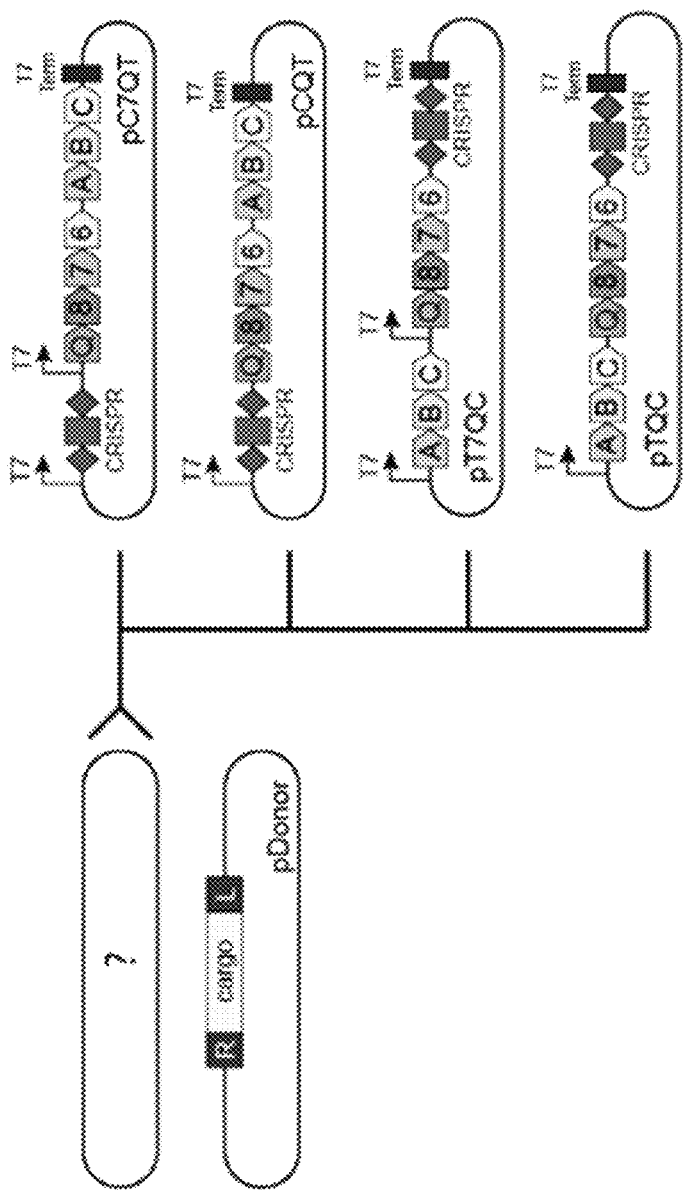
FIG. 87B

| gRNA ID | Encoded by | Description | Targeting complex | CRISPR repeat sequence (5'→3') | Spacer sequence (5'→3') | Full length gRNA sequence (5'→3') | Genomic coordinates of target site | PAM |
|---|---|---|---|---|---|---|---|---|
| gRNA-nt | pSL0762 | Non-targeting | V. cholerae Cascade | (SEQ ID No. 154) GTGAACTGCCGAGTAGGTAGCTGATAAC | (SEQ ID No. 155) GTTGTCTGACACTTGTCACAAACCGCTAGGAG | (SEQ ID No. 156) CUGAUAACGUUGUCUGACACUUGUCACAAACCGGAGGUGAACUGCCGAGUAG | - | - |
| gRNA-1 | pSL0826 | Target-1 (glmS locus) | V. cholerae Cascade | (SEQ ID No. 157) GTGAACTGCCGAGTAGGTAGCTGATAAC | (SEQ ID No. 158) TGGCAGGATTCATAAAGCATTGTTTGTTGGCT | (SEQ ID No. 159) CUGAUAACUGCGGAGGAUUCAUAAAGCAUUGUUUGUUGGCUGUGAACUGCCGAGUAGAGGUAG | 380035-380067 | CC |
| gRNA-2 | pSL0827 | Target-2 (glmS locus) | V. cholerae Cascade | (SEQ ID No. 160) GTGAACTGCCGAGTAGGTAGCTGATAAC | (SEQ ID No. 161) GTCATCTTCGGCTACTTTTTCTCTGTCACAGA | (SEQ ID No. 162) CUGAUAACGUCAUCUUCGGCUACUUUUUCUCUGUCACAGAGUGAACUGCCGAGUAGAGGUAG | complement (380524-380555) | CC |
| gRNA-3 | pSL0778 pSL0915 | Target-3 (lacZ locus) | V. cholerae Cascade | (SEQ ID No. 163) GTGAACTGCCGAGTAGGTAGCTGATAAC | (SEQ ID No. 164) TATCCATTACGGTCAATCCGCCGTTTGTTCC | (SEQ ID No. 165) CUGAUAACUAUCCAUUACGGUCAAUCCGCCGUUUGUUCCGUGAACUGCCGAGUAGAGGUAG | complement (335494-335525) | CC |
| gRNA-4 | pSL0828 | Target-4 (lacZ locus) | V. cholerae Cascade | (SEQ ID No. 166) GTGAACTGCCGAGTAGGTAGCTGATAAC | (SEQ ID No. 167) AGTACAGGCGCGGTGAAATCATCATTAAAGCG | (SEQ ID No. 168) CUGAUAACAGUACAGGCGCGGUGAAAUCAUCAUUAAAGCGGUGAACUGCCGAGUAGAGGUAG | 335119-335150 | CC |
| gRNA-5 | pSL0829 | Target-5 (lacZ locus) | V. cholerae Cascade | (SEQ ID No. 169) GTGAACTGCCGAGTAGGTAGCTGATAAC | (SEQ ID No. 170) AGCGGTGCACGGGTGAACGATCGCGCAGCGG | (SEQ ID No. 171) CUGAUAACAGCGGUGCACGGGUGAACGAUCGCGCAGCGGGUGAACUGCCGAGUAGAGGUAG | 335472-335503 | CC |
| gRNA-6 | pSL0830 | Target-6 (lacZ locus) | V. cholerae Cascade | (SEQ ID No. 172) GTGAACTGCCGAGTAGGTAGCTGATAAC | (SEQ ID No. 173) GCGCCACTGTGTGGGCCATAATTCAATTCGC | (SEQ ID No. 174) CUGAUAACGCGCCACUGGUGUGGGCCAUAAUUCAAUUCGCGUGAACUGCCGAGUAGAGGUAG | 332982-333013 | CC |

FIG. 100A

| gRNA ID | Encoded by | Description | Targeting complex | CRISPR repeat sequence (5'→3') | Spacer sequence (5'→3') | Full length gRNA sequence (5'→3') | Genomic coordinates of target site* | PAM† |
|---|---|---|---|---|---|---|---|---|
| gRNA-7 | pSL0851 | Target-7 (lacY locus) | V. cholerae Cascade | (SEQ ID No. 175) GTGAACTGCCG AGTAGGTAGCT GATAAC | (SEQ ID No. 176) AAAAGTTTGTGT TTTTAAATAGT ACATAATG | (SEQ ID No. 177) CUGAUAACAAAAGUUUGU GUUUUUAAAUAGUACACA AAUGGUGAACUGCCGAGU AGGUAG | 332687-332718 | CC |
| gRNA-8 | pSL0852 | Target-8 (lacY locus) | V. cholerae Cascade | (SEQ ID No. 178) GTGAACTGCCG AGTAGGTAGCT GATAAC | (SEQ ID No. 179) CGAGTTGTCAG AAAGCAGACCA AACACGGT | (SEQ ID No. 180) CUGAUAACCGAGUUGUC AGAAAGCAGACCAAACAG CGGUGAACUGCCGAGU AGGUAG | 332504-332535 | CC |
| gRNA-9 | pSL0910 | Target-9 (yadD-paaC locus) | V. cholerae Cascade | (SEQ ID No. 181) GTGAACTGCCG AGTAGGTAGCT GATAAC | (SEQ ID No. 182) GCCTGGCTTGGC GATGCTCGCCTG ATCGACAA | (SEQ ID No. 183) CUGAUAACGCCUGGCUUG GCGAUGCUGCCUGAUCG ACAAGUGAACUGCCGAGU AGGUAG | complement (150770-150801) | CC |
| gRNA-10 | pSL0903 | Target-10 (aroG-gpmA locus) | V. cholerae Cascade | (SEQ ID No. 184) GTGAACTGCCG AGTAGGTAGCT GATAAC | (SEQ ID No. 185) GTCAGAGTGGC GTAUCCGAUGAA TCACCACAG | (SEQ ID No. 186) CUGAUAACGUCAGAGUGG CGUAUCCGAUGAAUCACC ACAGGUGAACUGCCGAGU AGGUAG | 745115-745146 | CC |
| gRNA-11 | pSL0904 | Target-11 (ompW-yciE locus) | V. cholerae Cascade | (SEQ ID No. 187) GTGAACTGCCG AGTAGGTAGCT GATAAC | (SEQ ID No. 188) TCGATCCGTGG TGTTUATGTUCT CAGCAGGA | (SEQ ID No. 189) CUGAUAACUCGAUCCGUG GUGUUUAUGUUCUCAGC AGGAGUGAACUGCCGAGU AGGUAG | 1300207-1300238 | CC |
| gRNA-12 | pSL0905 | Target-12 (purT-eda locus) | V. cholerae Cascade | (SEQ ID No. 190) GTGAACTGCCG AGTAGGTAGCT GATAAC | (SEQ ID No. 191) GCATTACTAAGC TGGCGCCTGAA GCTCTAGAA | (SEQ ID No. 192) CUGAUAACGCAUUACUAA GCUGGCGCCUGAAGCUGU AGAAGUGAACUGCCGAGU AGGUAG | complement (1877854-1877885) | CC |
| gRNA-13 | pSL0898 | Target-13 (tktB-cypG locus) | V. cholerae Cascade | (SEQ ID No. 193) GTGAACTGCCG AGTAGGTAGCT GATAAC | (SEQ ID No. 194) GAGAATATTGTG GCAAAAGCGCA TAAGGTGCT | (SEQ ID No. 195) CUGAUAACCAGAAUAUUG UGGCAAAAGCGCAUAAGG UGCUGUGAACUGCCGAGU AGGUAG | 2446078-2446109 | CC |

FIG. 100B

| gRNA ID | Encoded by | Description | Targeting complex | CRISPR repeat sequence (5'→3') | Spacer sequence (5'→3') | Full length gRNA sequence (5'→3') | Genomic coordinates of target site* | PAM |
|---|---|---|---|---|---|---|---|---|
| gRNA-14 | pSL0899 | Target-14 (yghA-exbD locus) | V. cholerae Cascade | (SEQ ID No. 196) GTGAACTGCCG AGTAGGTAGCT GATAAC | (SEQ ID No. 197) GCAGAAGTCA CGGCGTGTGCG CGGCGAGCA | (SEQ ID No. 198) CUGAUAACGCAGAAGUGC ACGGCGUGUGCGGCGGCG AGCAGUGAACUGCCGAGU AGGUAG | 3017942-3017973 | CC |
| gRNA-15 | pSL0908 | Target-15 (cspA-hokA locus) | V. cholerae Cascade | (SEQ ID No. 199) GTGAACTGCCG AGTAGGTAGCT GATAAC | (SEQ ID No. 200) TTACTTACGGCG CGTIGCGCATTC TCATTG | (SEQ ID No. 201) CUGAUAACUACUUACGG CGUUGCGCAUUCUCAUUG CACCGUGAACUGCCGAGU AGGUAG | complement (3582340-3582370) | CC |
| gRNA-16 | pSL0901 | Target-16 (rluF-yjbD locus) | V. cholerae Cascade | (SEQ ID No. 202) GTGAACTGCCG AGTAGGTAGCT GATAAC | (SEQ ID No. 203) GGGCGTAAAA AGAAGGGGCG TGATTAACGC | (SEQ ID No. 204) CUGAUAACGGGGCGUAAA AAGAAGGGGCGUGAUUAA CGCGUGAACUGCCGAGU AGGUAG | 4138573-4138604 | CC |
| gRNA-17 | pSL0902 | Target-17 (yjdD-pamC locus) | V. cholerae Cascade | (SEQ ID No. 205) GTGAACTGCCG AGTAGGTAGCT GATAAC | (SEQ ID No. 206) TCTTGCTGAGAT TGATAAGGTAAT TAACCTTA | (SEQ ID No. 207) CUGAUAACUCUUGCUGAG AUUGAUAAGGUAAUUAAC CUUAGUGAACUGCCGAGU AGGUAG | 150638-150669 | CC |
| gRNA-18 | pSL0911 | Target-18 (arcG-gpmA locus) | V. cholerae Cascade | (SEQ ID No. 208) GTGAACTGCCG AGTAGGTAGCT GATAAC | (SEQ ID No. 209) GACTGCAAGTG AGTCGGCTTTT TGTTGCTAA | (SEQ ID No. 210) CUGAUAACGACUGCAAGU GAGUCGGCUUUUUGUUG CUAAGUGAACUGCCGAGU AGGUAG | complement (74192-245223) | CC |
| gRNA-19 | pSL0912 | Target-19 (cmpW-yciE locus) | V. cholerae Cascade | (SEQ ID No. 211) GTGAACTGCCG AGTAGGTAGCT GATAAC | (SEQ ID No. 212) GCAAACAACTG AGAAATTTTAA TTCGCTCTG | (SEQ ID No. 213) CUGAUAACGCAAACAACU GAGAAAUUUUAAUUCGC UCUGGUGAACUGCCGAGU AGGUAG | complement (1360359-1360370) | CC |
| gRNA-20 | pSL0897 | Target-20 (purT-eda locus) | V. cholerae Cascade | (SEQ ID No. 214) GTGAACTGCCG AGTAGGTAGCT GATAAC | (SEQ ID No. 215) ATTGAACGCCG AAGCACGCCGC CGGACAGGT | (SEQ ID No. 216) CUGAUAACAUUGAACGCCG CGAAGCACGCCGCCGGAC AGGUGAACUGCCGAGU AGGUAG | 1877736-1877767 | CC |

FIG. 100C

| gRNA ID | Encoded by | Description | Targeting complex | CRISPR repeat sequence (5'→3') | Spacer sequence (5'→3') | Full length gRNA sequence (5'→3') | Genomic coordinates of target site* | PAM† |
|---|---|---|---|---|---|---|---|---|
| gRNA-2.1 | pSL0906 | Target-21 (fxtB-ybfO locus) | V. cholerae Cascade | (SEQ ID No. 217) GTGAACTGCCG AGTAGGTAGCT GATAAC | (SEQ ID No. 218) TGGCCCACGTTG TGGATCACCCGT TAAACAAA | (SEQ ID No. 219) CUGAUAACUGCCGAGU UGUGGAUCACCCGUUAA CAAGUGAACUGCCGAGU AGGUAG | complement (3146318-3146349) | CC |
| gRNA-2.2 | pSL0907 | Target-22 (yghA-exbD locus) | V. cholerae Cascade | (SEQ ID No. 220) GTGAACTGCCG AGTAGGTAGCT GATAAC | (SEQ ID No. 221) TGAAGATAGGTC TGGTCGGGAA GAAACCGCC | (SEQ ID No. 222) CUGAUAACUGCCGAAGAUAGG UCUGGUCGGGAAGAAAC CGCCGUGAACUGCCGAGU AGGUAG | complement (3018267-3018298) | CC |
| gRNA-2.3 | pSL0908 | Target-23 (cspA-hokA locus) | V. cholerae Cascade | (SEQ ID No. 223) GTGAACTGCCG AGTAGGTAGCT GATAAC | (SEQ ID No. 224) AGCCTGTAATCT CTGCTTAAAGC ACAGAATA | (SEQ ID No. 225) CUGAUAACAGCCUGUAAU CUCUGCUUAAAGCACAG AAUCUGAACUGCCGAGU AGGUAG | 3382407-3392438 | CC |
| gRNA-2.4 | pSL0909 | Target-24 (rhaF-yjbD locus) | V. cholerae Cascade | (SEQ ID No. 226) GTGAACTGCCG AGTAGGTAGCT GATAAC | (SEQ ID No. 227) TGAGATTTCAC TCGTCAGTGTGA ACACAATT | (SEQ ID No. 228) CUGAUAACUGAGAUUUC ACUCGUCAGUGUGAACAC AAUUGAACUGCCGAGU AGGUAG | complement (4136683-4136714) | CC |
| gRNA-4.1 | pSL0855 | PAM tiling, Target-4, shifted -1 nt | V. cholerae Cascade | (SEQ ID No. 229) GTGAACTGCCG AGTAGGTAGCT GATAAC | (SEQ ID No. 230) GTACAGCGCGG CTGAAATCATCA TTAAGGA | (SEQ ID No. 231) CUGAUAACGUACAGCGCCG GCUGAAAUCAUCAUUAA GGAGUGAACUGCCGAGU AGGUAG | 335120-335151 | CA |
| gRNA-4.2 | pSL0854 | PAM tiling, Target-4, shifted -2 nt | V. cholerae Cascade | (SEQ ID No. 232) GTGAACTGCCG AGTAGGTAGCT GATAAC | (SEQ ID No. 233) TACAGCGCGGCT GAAATCATCATT AAAGCCAG | (SEQ ID No. 234) CUGAUAACAGCGCGG CUGAAAUCAUCAUUAAAG CCAGGUGAACUGCCGAGU AGGUAG | 335121-335152 | AG |
| gRNA-4.3 | pSL0853 | PAM tiling, Target-4, shifted -3 nt | V. cholerae Cascade | (SEQ ID No. 235) GTGAACTGCCG AGTAGGTAGCT GATAAC | (SEQ ID No. 236) ACAGCGCGGCT GAAATCATCATT AAAGCCAGT | (SEQ ID No. 237) CUGAUAACACAGCGCGGC UGAAAUCAUCAUUAAAGC GAGUGAACUGCCGAGU AGGUAG | 335122-335153 | GT |

FIG. 100D

| gRNA ID | Encoded by | Description | Targeting complex | CRISPR repeat sequence (5'–3') | Spacer sequence (5'–3') | Full length gRNA sequence (5'–3') | Genomic coordinates of target site* | PAM: |
|---|---|---|---|---|---|---|---|---|
| gRNA-4.4 | pSL0852 | PAM tiling, Target-4, shifted +4-nt | V. cholerae Cascade | (SEQ ID No. 238) GTGAACTGCCG AGTAGGTAGCT GATAAC | (SEQ ID No. 239) CAGCGGGCTG AAATCATCATTA AAGCGAGTG | (SEQ ID No. 240) CUGAUAACCAGCGGGCU GAAAUCAUCAUUAAAGCG AGUGGUGAACUGCCGAGU AGGUAG | 335123-335154 | TA |
| gRNA-4.5 | pSL0851 | PAM tiling, Target-4, shifted +5-nt | V. cholerae Cascade | (SEQ ID No. 241) GTGAACTGCCG AGTAGGTAGCT GATAAC | (SEQ ID No. 242) AGCGGGCTGA AATCATCATTAA AGCGAGTGG | (SEQ ID No. 243) CUGAUAACAGCGGGCUG AAAUCAUCAUUAAAGCGA GUGGUGAACUGCCGAGU AGGUAG | 335124-335155 | AC |
| gRNA-4.6 | pSL0763 | PAM tiling, Target-4, shifted +6-nt | V. cholerae Cascade | (SEQ ID No. 244) GTGAACTGCCG AGTAGGTAGCT GATAAC | (SEQ ID No. 245) GCGGGCTGAA ATCATCATTAAA GCGAGTGGC | (SEQ ID No. 246) CUGAUAACGCGGGCUGA AAUCAUCAUUAAAGCGAG UGGCUGAACUGCCGAGU AGGUAG | 335125-335156 | CA |
| gRNA-4.7 | pSL0764 | PAM tiling, Target-4, shifted +7-nt | V. cholerae Cascade | (SEQ ID No. 247) GTGAACTGCCG AGTAGGTAGCT GATAAC | (SEQ ID No. 248) CGGGCTGAAAT CATCATTAAAGC GAGTGCA | (SEQ ID No. 249) CUGAUAACCGGGCUGAA AUCAUCAUUAAAGCGAGU GGCAGUGAACUGCCGAGU AGGUAG | 335126-335157 | AG |
| gRNA-4.8 | pSL0765 | PAM tiling, Target-4, shifted +8-nt | V. cholerae Cascade | (SEQ ID No. 250) GTGAACTGCCG AGTAGGTAGCT GATAAC | (SEQ ID No. 251) GGGCTGAAATC ATCATTAAAGCG AGTGCAA | (SEQ ID No. 252) CUGAUAACGGGCUGAAA UCAUCAUUAAAGCGAGUG GCAAGUGAACUGCCGAGU AGGUAG | 335127-335158 | GC |
| gRNA-4.9 | pSL0766 | PAM tiling, Target-4, shifted +9-nt | V. cholerae Cascade | (SEQ ID No. 253) GTGAACTGCCG AGTAGGTAGCT GATAAC | (SEQ ID No. 254) GGCTGAAATCA TCATTAAAGCGA GTGCAAC | (SEQ ID No. 255) CUGAUAACGGCUGAAAU CAUCAUUAAAGCGAGUGG CAACGUGAACUGCCGAGU AGGUAG | 335128-335159 | CG |
| gRNA-4.10 | pSL0767 | PAM tiling, Target-4, shifted +10-nt | V. cholerae Cascade | (SEQ ID No. 256) GTGAACTGCCG AGTAGGTAGCT GATAAC | (SEQ ID No. 257) GCTGAAATCAT CATTAAAGCGA GTGCAACA | (SEQ ID No. 258) CUGAUAACGCUGAAAUC AUCAUUAAAGCGAGUGG AACAGUGAACUGCCGAGU AGGUAG | 335129-335160 | GC |

FIG. 100E

| gRNA ID | Encoded by | Description | Targeting complex | CRISPR repeat sequence (5'–3') | Spacer sequence (5'–3') | Full length gRNA sequence (5'–3') | Genomic coordinates of target site* | PAM† |
|---|---|---|---|---|---|---|---|---|
| gRNA-4.11 | pSL0755 | PAM tiling, Target-4, shifted +11-nt | V. cholerae Cascade | (SEQ ID No. 259) GTGAACTGCCG AGTAGTAGCT GATAAC | (SEQ ID No. 260) GCTGAATCATC ATTAAAGCGAGT GGCACAT | (SEQ ID No. 261) CUGAUAACGCUGAAAUCA UCAUUAAGCGAGUGGCA ACAUGGAACUGCCGAGU AGGUAG | 335130-335161 | CG |
| gRNA-4.12 | pSL0768 | PAM tiling, Target-4, shifted +12-nt | V. cholerae Cascade | (SEQ ID No. 262) GTGAACTGCCG AGTAGTAGCT GATAAC | (SEQ ID No. 263) CTGAAATCATCA TTAAAGCGAGTG GCAACATG | (SEQ ID No. 264) CUGAUAACCUGAAAUCAU CAUUAAGCGAGUGGCAA CAUGGAACUGCCGAGU AGGUAG | 335131-335162 | GG |
| gRNA-4.13 | pSL0769 | PAM tiling, Target-4, shifted +13-nt | V. cholerae Cascade | (SEQ ID No. 265) GTGAACTGCCG AGTAGTAGCT GATAAC | (SEQ ID No. 266) TGAAATCATCAT TAAAGCGAGTG GCAACATGG | (SEQ ID No. 267) CUGAUAACUGAAAUCAUC AUUAAAGCGAGUGGCAAC AUGGGUGAACUGCCGAGU AGGUAG | 335132-335163 | GC |
| gRNA-4.14 | pSL0757 | PAM tiling, Target-4, shifted +14-nt | V. cholerae Cascade | (SEQ ID No. 268) GTGAACTGCCG AGTAGTAGCT GATAAC | (SEQ ID No. 269) GAAATCATTATT AAAGCGAGTGG CAACATGGA | (SEQ ID No. 270) CUGAUAACGAAAUCAUCA UUAAGCGAGUGGCAACAU UGGAGUGAACUGCCGAGU AGGUAG | 335133-335164 | CT |
| gRNA-4.15 | pSL0770 | PAM tiling, Target-4, shifted +15-nt | V. cholerae Cascade | (SEQ ID No. 271) GTGAACTGCCG AGTAGTAGCT GATAAC | (SEQ ID No. 272) AAATCATCATTA AAGCGAGTGGC AACATGGAA | (SEQ ID No. 273) CUGAUAACAAAUCAUCAU UAAGCGAGUUGGCAACAU GGGAGUGAACUGCCGAGU AGGUAG | 335134-335165 | TG |
| gRNA-4.16 | pSL0771 | PAM tiling, Target-4, shifted +16-nt | V. cholerae Cascade | (SEQ ID No. 274) GTGAACTGCCG AGTAGTAGCT GATAAC | (SEQ ID No. 275) AATCATCATTAA AGCGAGTGGCA ACATGGAAA | (SEQ ID No. 276) CUGAUAACAAUCAUCAUU AAAGCGAGUGGCAACAUG GAAGUGAACUGCCGAGU AGGUAG | 335135-335166 | GA |
| gRNA-4.mm1-4 | pSL0664 | Target-4 mismatches bp 1-4 | V. cholerae Cascade | (SEQ ID No. 277) GTGAACTGCCG AGTAGTAGCT GATAAC | (SEQ ID No. 278) TCATCAGCGGG CTGAAATCATCA TTAAAGCG | (SEQ ID No. 279) CUGAUAACUCAUCAGCGC GGCUGAAAUCAUCAUUAA AGCGGUGAACUGCCGAGU AGGUAG | 335119-335150 | CC |

FIG. 100F

| gRNA ID | Encoded by | Description | Targeting complex | CRISPR repeat sequence (5'→3') | Spacer sequence (5'→3') | Full length gRNA sequence (5'→3') | Genomic coordinates of target site* | PAM† |
|---|---|---|---|---|---|---|---|---|
| gRNA-4.mm5-8 | pSL0865 | Target-4, mismatches bp 5-8 | V. cholerae Cascade | (SEQ ID No. 280) GTGAACTGCCG AGTAGGTAGCT GATAAC | (SEQ ID No. 281) AGTAGTCGGG GCTGAAATCATC ATTAAAGCG | (SEQ ID No. 282) CUGAUAACAGUAGUCGGGC GGCUGAAAUCAUCAUUAA AGCGGGUGAACUGCCGAGU AGGUAG | 335119-335150 | CC |
| gRNA-4.mm9-12 | pSL0866 | Target-4, mismatches bp 9-12 | V. cholerae Cascade | (SEQ ID No. 283) GTGAACTGCCG AGTAGGTAGCT GATAAC | (SEQ ID No. 284) AGTACAGCGCC CTGAAATCATCA TTAAAGCG | (SEQ ID No. 285) CUGAUAACAGUACAGCCC CCUGAAAUCAUCAUUAA AGCGGGUGAACUGCCGAGU AGGUAG | 335119-335150 | CC |
| gRNA-4.mm13-16 | pSL0867 | Target-4, mismatches bp 13-16 | V. cholerae Cascade | (SEQ ID No. 286) GTGAACTGCCG AGTAGGTAGCT GATAAC | (SEQ ID No. 287) AGTACAGCGCC GGACTAATCATC TTAAAGCG | (SEQ ID No. 288) CUGAUAACAGUACAGCGCC GGACUAAUCAUCAUUAA AGCGGGUGAACUGCCGAGU AGGUAG | 335119-335150 | CC |
| gRNA-4.mm17-20 | pSL0868 | Target-4, mismatches bp 17-20 | V. cholerae Cascade | (SEQ ID No. 289) GTGAACTGCCG AGTAGGTAGCT GATAAC | (SEQ ID No. 290) AGTACAGCGCC GCTGATTAGATC ATTAAAGCG | (SEQ ID No. 291) CUGAUAACAGUACAGCGC GGCUGAUUAGAUCAUUAA AGCGGGUGAACUGCCGAGU AGGUAG | 335119-335150 | CC |
| gRNA-4.mm21-24 | pSL0869 | Target-4, mismatches bp 21-24 | V. cholerae Cascade | (SEQ ID No. 292) GTGAACTGCCG AGTAGGTAGCT GATAAC | (SEQ ID No. 293) AGTACAGCGCC GCTGAAATCTAG TTTAAGCG | (SEQ ID No. 294) CUGAUAACAGUACAGCGC GGCUGAAAUCUAGUUUAA AGCGGGUGAACUGCCGAGU AGGUAG | 335119-335150 | CC |
| gRNA-4.mm25-28 | pSL0870 | Target-4, mismatches bp 25-28 | V. cholerae Cascade | (SEQ ID No. 295) GTGAACTGCCG AGTAGGTAGCT GATAAC | (SEQ ID No. 296) AGTACAGCGCC GCTGAAATCATC AAATTAGCG | (SEQ ID No. 297) CUGAUAACAGUACAGCGC GGCUGAAAUCAUCAAAUU AGCGGGUGAACUGCCGAGU AGGUAG | 335119-335150 | CC |
| gRNA-4.mm29-32 | pSL0871 | Target-4, mismatches bp 29-32 | V. cholerae Cascade | (SEQ ID No. 298) GTGAACTGCCG AGTAGGTAGCT GATAAC | (SEQ ID No. 299) AGTACAGCGCC GCTGAAATCATC ATTAATCGC | (SEQ ID No. 300) CUGAUAACAGUACAGCGC GGCUGAAAUCAUCAUUAA UCGCGGUGAACUGCCGAGU AGGUAG | 335119-335150 | CC |

FIG. 100G

| gRNA ID | Encoded by | Description | Targeting complex | CRISPR repeat sequence (5'→3') | Spacer sequence (5'→3') | Full length gRNA sequence (5'→3') | Genomic coordinates of target site* | PAM: |
|---|---|---|---|---|---|---|---|---|
| gRNA-4, -24nt | pSL0959 | Target-4, -24 shortened spacer length (8-nt) | V. cholerae Cascade | (SEQ ID No. 301) GTGAACTGCCG AGTAGGTAGCT GATAAC | (SEQ ID No. 302) AGTACAGC | (SEQ ID No. 303) CUGAUAACAGUACAGCGU GAACUGCCGAGUAGGUAG | 335119-335126 | CC |
| gRNA-4, -18nt | pSL0960 | Target-4, -18 shortened spacer length (14-nt) | V. cholerae Cascade | (SEQ ID No. 304) GTGAACTGCCG AGTAGGTAGCT GATAAC | (SEQ ID No. 305) AGTACAGCGCG GCT | (SEQ ID No. 306) CUGAUAACAGUACAGCGC GGCUGUGAACUGCCGAGU AGGUAG | 335119-335132 | CC |
| gRNA-4, -12nt | pSL0961 | Target-4, -12 shortened spacer length (20-nt) | V. cholerae Cascade | (SEQ ID No. 307) GTGAACTGCCG AGTAGGTAGCT GATAAC | (SEQ ID No. 308) AGTACAGCGCG GCTGAAATC | (SEQ ID No. 309) CUGAUAACAGUACAGCGC GGCUGAAAUCGUGAACUGC CGAGUAGGUAG | 335119-335138 | CC |
| gRNA-4, -6nt | pSL0962 | Target-4, -6 shortened spacer length (26-nt) | V. cholerae Cascade | (SEQ ID No. 310) GTGAACTGCCG AGTAGGTAGCT GATAAC | (SEQ ID No. 311) AGTACAGCGCG GCTGAAATCATC ATT | (SEQ ID No. 312) CUGAUAACAGUACAGCGC GGCUGAAAUCAUCAUUGU GAACUGCCGAGUAGGUAG | 335119-335144 | CC |
| gRNA-4, +6nt | pSL0963 | Target-4, +6 extended spacer length (38-nt) | V. cholerae Cascade | (SEQ ID No. 313) GTGAACTGCCG AGTAGGTAGCT GATAAC | (SEQ ID No. 314) AGTACAGCGCG GCTGAAATCATC ATTAAAGGAGT GGC | (SEQ ID No. 315) CUGAUAACAGUACAGCGC GGCUGAAAUCAUCAUUAA AGGAGUGGCGUGAACUGC CGAGUAGGUAG | 335119-335156 | CC |
| gRNA-4, +12nt | pSL0964 | Target-4, +12 extended spacer length (44-nt) | V. cholerae Cascade | (SEQ ID No. 316) GTGAACTGCCG AGTAGGTAGCT GATAAC | (SEQ ID No. 317) AGTACAGCGCG GCTGAAATCATC ATTAAAGGAGT GGCAACATG | (SEQ ID No. 318) CUGAUAACAGUACAGCGC GGCUGAAAUCAUCAUUAA AGGAGUGGCAACAUGGUA GGUAG | 335119-335162 | CC |
| gRNA-4, +18nt | pSL0965 | Target-4, +18 extended spacer length (50-nt) | V. cholerae Cascade | (SEQ ID No. 319) GTGAACTGCCG AGTAGGTAGCT GATAAC | (SEQ ID No. 320) AGTACAGCGCG GCTGAAATCATC ATTAAAGGAGT GGCAACATGGA AATC | (SEQ ID No. 321) CUGAUAACAGUACAGCGC GGCUGAAAUCAUCAUUAA AGGAGUGGCAACAUGGA AAUCGUGAACUGCCGAGU AGGUAG | 335119-335168 | CC |

FIG. 100H

| gRNA ID | Encoded by | Description | Targeting complex | CRISPR repeat sequence (5'→3') | Spacer sequence (5'→3') | Full length gRNA sequence (5'→3') | Genomic coordinates of target site* | PAM† |
|---|---|---|---|---|---|---|---|---|
| gRNA-4-24nt | pSL0966 | Target-4, +24 extended spacer length (36-nt) | V. cholerae Cascade | (SEQ ID No. 322) GTGAACTGCCG AGTAGGTAGCT GATAAC | (SEQ ID No. 323) AGTACACGCG GCTGAAATCATC ATTAAAGGCAGT GGCAACATGGA AATCGCTGAT | (SEQ ID No. 324) CUGAUAACAGUACAGCGC GGCUGAAAUCAUCAUUAA AGCGAGUGGCAACAUGGA AAUCGCUGAUGUGAACUG CCGAGUAGGUAG | 335119-335174 | CC |
| gRNA-sp3 | pSL0426 | Spacer-3 (native spacer) | V. cholerae Cascade | (SEQ ID No. 325) GTGAACTGCCG AGTAGGTAGCT GATAAC | (SEQ ID No. 326) TTACAGGACGCT TGGCTTCATTG CTTTTCAG | (SEQ ID No. 327) CUGAUAACUUACAGGACG CUUUGGCUUCAUUGCUUU UCAGGUCGACUGCGGAGU AGGUAG | - | - |
| sgRNA-nt (BsaI) | pSL0728 | Cas9 non-targeting (BsaI stuffer) | S. pyogenes Cas9 | N/A | (SEQ ID No. 328) GGAGACCAGTCT AGGTCTCG | (SEQ ID No. 329) GGGAGACCAGUCUAGGUC UCGGUUUUAGAGCUAGAA AUAGCAAGUUAAAAUAAG GCUAGUCCGUUAUCAACU UGAAAAAGUGGCACCGAG UCGGUGCUUUUUU | - | - |
| sgRNA-3 | pSL0885 | Cas9 target proximal to Vch Target-3 | S. pyogenes Cas9 | N/A | (SEQ ID No. 330) CGGATTGACCGT AATGGGAT | (SEQ ID No. 331) GCGGAUUGACCGUAAUGG GAUGUUUUAGAGCUAGAA AUAGCAAGUUAAAAUAAG GCUAGUCCGUUAUCAACU UGAAAAAGUGGCACCGAG UCGGUGCUUUUUU | - | AGG |
| sgRNA-4 | pSL0886 (pSL0888) | (d)Cas9 target proximal to Vch Target-4 | S. pyogenes Cas9 | N/A | (SEQ ID No. 332) TGATTTCAGCCG CGCTGTAC | (SEQ ID No. 333) GUGAUUUCAGCCGCGCUG UACGUUUUAGAGCUAGAA AUAGCAAGUUAAAAUAAG GCUAGUCCGUUAUCAACU UGAAAAAGUGGCACCGAG UCGGUGCUUUUUU | complement (335120-335139) | TGG |
| gRNA-Paer (BsaI) | pSL0295 | Pae non-targeting (BsaI stuffer) | P. aeruginosa Cascade | (SEQ ID No. 334) GTTCACTGCCG TATAGGCAGCT AAGAAA | (SEQ ID No. 335) CGAGACCTCAAT TGGTCTCC | (SEQ ID No. 336) CUAAGAAGAGACCCUCA AUUGGUCUCCGUUCACUG CCGUAUAGGCAG | - | - |

FIG. 100I

| gRNA ID | Encoded by | Description | Targeting complex | CRISPR repeat sequence (5'→3') | Spacer sequence (5'→3') | Full length gRNA sequence (5'→3') | Genomic coordinates of target site* | PAM† |
|---|---|---|---|---|---|---|---|---|
| gRNA-Pae3 | pSL0872 | Pae target, same as Vch Target-3 | P. aeruginosa Cascade | (SEQ ID No. 337) GTTCACTGCCG TATAGGCAGCT AAGAAA | (SEQ ID No. 338) TATCCCATTACG GTCAATCCGCCG TTTGTTCC | (SEQ ID No. 339) CUAAGAAUAUCCCAUUA CGGUCAAUCCGCCGUUUG UUCCGUUCACUGCCGUAU AGGCAG | complement (335494-335525) | CC |
| gRNA-Pae4 | pSL0873 | Pae target, same as Vch Target-4 | P. aeruginosa Cascade | (SEQ ID No. 340) GTTCACTGCCG TATAGGCAGCT AAGAAA | (SEQ ID No. 341) AGTACAGGGCG GCTGAAATCATC ATTAAAGCG | (SEQ ID No. 342) CUAAGAAAGUACAGGGC GGCUGAAAUCAUCAUUAA AGCGGUUCACUGCCGUAU AGGCAG | 335119-335150 | CC |

FIG. 100J

| Oligo ID | Use | Sequence |
|---|---|---|
| oSL0763 | PCR | GTGGTATTCACTCCAGAGCG (SEQ ID No. 343) |
| oSL0388 | PCR | CAACAGTACTGCGATGAG (SEQ ID No. 344) |
| oSL1712 | PCR | CGAACCTGTTCAACGAC (SEQ ID No. 345) |
| oSL1709 | PCR | CGAACTGCTGTCGAAG (SEQ ID No. 346) |
| oSL0842 | PCR | GCCCGAGTTTGTCAGAAAGC (SEQ ID No. 347) |
| oSL0311 | PCR | CGTCCTGTGGATCCTCTAC (SEQ ID No. 348) |
| oSL0400 | PCR | GCATCAACGCATATAGCG (SEQ ID No. 349) |
| oSL1177 | PCR | CATGCAGTATTCCAGGACTC (SEQ ID No. 350) |
| oSL1178 | PCR | GGAGAGCAAATCTTGTTGC (SEQ ID No. 351) |
| oSL1303 | cPCR | CACCACAGATGAAACGCCG (SEQ ID No. 352) |
| oSL1186 | cPCR | CATCTACACCAACGTGACCTATCC (SEQ ID No. 379) |
| oSL1164 | (c)PCR | CGCCGCACATCTGAACTTC (SEQ ID No. 353) |
| oSL1163 | (c)PCR | GTCTGAATTTGACCTGAGCGC (SEQ ID No. 354) |

FIG. 101A

| Oligo ID | Use | Sequence |
|---|---|---|
| oSL1177 | qPCR | CATGCAGTATTCCAGGACTC (SEQ ID No. 355) |
| oSL1178 | qPCR | GGAGAGCAAATCTTGTTGC (SEQ ID No. 356) |
| oSL1304 | qPCR | GCGCTCAGGTCAAATTCAGAC (SEQ ID No. 357) |
| oSL1307 | qPCR | GGAGTGACGGCAGTTATCTG (SEQ ID No. 358) |
| oSL1164 | qPCR | CGCCGCACATCTGAACTTC (SEQ ID No. 359) |
| oSL1184 | qPCR | CTGAAGTTTAGACCATGAAGAGGC (SEQ ID No. 360) |
| oSL1185 | qPCR | GGTTGTTTTGTGGTTAAGTTGCTG (SEQ ID No. 361) |

FIG. 101B

| Oligo ID | Use | Sequence |
|---|---|---|
| oSL1623 | NGS | CTCTTTCCCTACACGACGCTCTTCCGATCTGCATTGTTTGTTGGCTACGAG (SEQ ID No. 362) |
| oSL1624 | NGS | CTCTTTCCCTACACGACGCTCTTCCGATCTGTTTGTAATTGACTGAATATCAACGC (SEQ ID No. 363) |
| oSL1625 | NGS | CTCTTTCCCTACACGACGCTCTTCCGATCTGGTGACAGTTATATGTAAGGAATATGACAG (SEQ ID No. 364) |
| oSL1626 | NGS | CTCTTTCCCTACACGACGCTCTTCCGATCTGCTACTTTTCTCTGTCACAGAATG (SEQ ID No. 365) |
| oSL1310 | NGS | CTCTTTCCCTACACGACGCTCTTCCGATCTACCACAGATGAAACGCC (SEQ ID No. 366) |
| oSL1309 | NGS | CTCTTTCCCTACACGACGCTCTTCCGATCTATCATTAAAGCGAGTGGCAAC (SEQ ID No. 367) |
| oSL1098 | NGS | GACTGGAGTTCAGACGTGTGCTCTTCCGATCTCTGAAGTTTAGACCATGAAGAGGC (SEQ ID No. 368) |
| oSL1101 | NGS | GACTGGAGTTCAGACGTGTGCTCTTCCGATCTGGTTGTTTTGTGGTTAAGTTGCTG (SEQ ID No. 369) |
| oSL1323 | NGS | CTGGAGTTCAGACGTGTGCTCTTCCGATCTGCGTTTCTACCTGCAGGG (SEQ ID No. 370) |
| oSL1368 | NGS | CTCTTTCCCTACACGACGCTCTTCCGATCTNN (SEQ ID No. 371) |
| oSL1369 | NGS | P-AGATCGGAAGAGCGTCGTGTAGGGAAAGAG (SEQ ID No. 372) |
| oSL1371 | NGS | ACACTCTTTCCCTACACGACGC (SEQ ID No. 373) |
| oSL1723 | NGS | 5rApp/AGATCGGAAGAGCACACGTCTGAACTCCAG/3ddC (SEQ ID No. 374) |
| oSL1724 | NGS | CTGGAGTTCAGACGTGTGCTCTTCCGATCT (SEQ ID No. 375) |
| oSL1725 | NGS | CUCUUUCCCUACACGACGCUCUUCCGAUCU (SEQ ID No. 376) |
| N/A | NGS | AATGATACGGCGACCACCGAGATCTACACNNNNNNNNACACTCTTTCCCTACACGACGC (SEQ ID No. 377) |
| N/A | NGS | CAAGCAGAAGACGGCATACGAGATNNNNNNNNGTGACTGGAGTTCAGACGTGTGC (SEQ ID No. 378) |

FIG. 101C

| NCBI Genome accession ID | Transposon startCoord | Transposon EndCoord | NCBI accession ID for TnsB | TnsB StartCoord | TnsB EndCoord | TnsB direction |
|---|---|---|---|---|---|---|
| NZ_NOJI01000009.1 | 15104 | 59319 | WP_119464978.1 | 15918 | 17729 | + |
| NZ_PYLX01000025.1 | 17023 | 42612 | WP_107250937.1 | 41801 | 39990 | - |
| NZ_LIXE01000015.1 | 20888 | 51613 | WP_119464619.1 | 21702 | 23513 | + |
| NZ_SYUM01000004.1 | 28898 | 81492 | WP_136985358.1 | 29649 | 31520 | + |
| NZ_PYLU01000010.1 | 124311 | 153260 | WP_107274795.1 | 152449 | 150638 | - |
| NZ_PYOO01000001.1 | 261740 | 290689 | WP_107274795.1 | 262551 | 264362 | + |
| NZ_AIDL02000029.1 | 10522 | 56314 | WP_016795651.1 | 55500 | 53689 | - |
| NZ_APHW01000105.1 | 46265 | 128761 | WP_038885460.1 | 47083 | 48909 | + |
| NZ_FNVG01000001.1 | 63510 | 121776 | WP_103878368.1 | 120962 | 119157 | - |
| NZ_MCVS01000025.1 | 396241 | 435706 | WP_102538708.1 | 396902 | 398863 | + |
| NZ_MCWR01000077.1 | 397294 | 436737 | WP_102526002.1 | 398045 | 399835 | + |
| NZ_MVJE01000005.1 | 91720 | 121245 | WP_086712134.1 | 120431 | 118620 | - |
| NZ_NNHQ01000001.1 | 174925 | 209858 | WP_053305643.1 | 209044 | 207233 | - |
| NZ_PYNV01000008.1 | 80491 | 104282 | WP_107246830.1 | 81305 | 83116 | + |
| NZ_QLYY01000013.1 | 133649 | 175929 | WP_114786278.1 | 175177 | 173303 | - |
| NZ_SPOT01000009.1 | 26582 | 67009 | WP_136677344.1 | 27334 | 29208 | + |
| NZ_SYVM01000070.1 | 41164 | 73042 | WP_136982639.1 | 72291 | 70420 | - |
| NZ_JSEN01000004.1 | 1885 | 26805 | WP_082828034.1 | 15035 | 13683 | - |
| NZ_JSEQ01000015.1 | 2134 | 27054 | WP_082828034.1 | 15284 | 13932 | - |
| NZ_SNUB01000030.1 | 3352 | 37730 | WP_134291474.1 | 36888 | 35047 | - |
| NZ_VIOO01000139.1 | 98959 | 126013 | WP_142542587.1 | 125266 | 123359 | - |
| NZ_MPHK01000004.1 | 223025 | 256059 | WP_076538387.1 | 255215 | 253362 | - |
| NZ_QEBK01000011.1 | 252760 | 291982 | WP_114778930.1 | 291235 | 289328 | - |
| NZ_POSI01000601.1 | 295534 | 323062 | WP_102952857.1 | 296275 | 298182 | + |
| NZ_QEAX01000001.1 | 357345 | 396567 | WP_114778930.1 | 395820 | 393913 | - |
| NZ_QECQ01000002.1 | 424314 | 463536 | WP_114778930.1 | 462789 | 460882 | - |

FIG. 102A

| NCBI Genome accession ID | Transposon startCoord | Transposon EndCoord | NCBI accession ID for TnsB | TnsB StartCoord | TnsB EndCoord | TnsB direction |
|---|---|---|---|---|---|---|
| NZ_ANFM02000036.1 | 44605 | 60502 | WP_002540938.1 | 59765 | 57885 | - |
| NZ_BAOG01000014.1 | 11676 | 44082 | WP_038875868.1 | 12418 | 14334 | + |
| NZ_BBLF01000006.1 | 135215 | 166075 | WP_045419481.1 | 165333 | 163417 | - |
| NZ_JPTP01000003.1 | 16836 | 56214 | WP_050907889.1 | 17578 | 19485 | + |
| NZ_LBFX01000002.1 | 272375 | 307337 | WP_057552674.1 | 306590 | 304683 | - |
| NZ_LBGC01000006.1 | 143553 | 178515 | WP_057552674.1 | 144300 | 146207 | + |
| NZ_NMSU01000018.1 | 66778 | 101740 | WP_057552674.1 | 67525 | 69432 | + |
| NZ_NMSV01000007.1 | 51699 | 86661 | WP_057552674.1 | 52446 | 54353 | + |
| NZ_QEBU01000008.1 | 66763 | 101725 | WP_057552674.1 | 67510 | 69417 | + |
| NZ_QNVL01000001.1 | 296900 | 330899 | WP_136285400.1 | 329352 | 327445 | - |
| NZ_PNCB01000022.1 | 3789 | 27014 | WP_138590899.1 | 26278 | 24440 | - |
| NZ_PNCF01000018.1 | 4182 | 27407 | WP_138590899.1 | 26671 | 24833 | - |
| NZ_LKDW01000019.1 | 20342 | 38562 | WP_055018246.1 | 37827 | 36004 | - |
| NZ_AUTR01000037.1 | 31979 | 52181 | WP_024590737.1 | 32714 | 34537 | + |
| NZ_AUTS01000021.1 | 31979 | 52181 | WP_024590737.1 | 32714 | 34537 | + |
| NZ_ML064597.1 | 19722 | 51969 | WP_121851997.1 | 42643 | 45096 | + |
| NZ_ML064597.1 | 42457 | 65763 | WP_121851997.1 | 42643 | 45096 | + |
| NZ_JPMC01000002.1 | 84103 | 111073 | WP_036953812.1 | 84838 | 86661 | + |
| NZ_LRUE01000024.1 | 419856 | 446473 | WP_062366900.1 | 420589 | 422430 | + |
| NZ_AHCF02000042.1 | 111880 | 134320 | WP_010388169.1 | 133585 | 131765 | - |
| NZ_BCAI01000009.1 | 90757 | 106936 | WP_053910945.1 | 106200 | 104362 | - |
| NZ_PYM01000003.1 | 36741 | 54623 | WP_053061935.1 | 38028 | 39347 | + |
| NZ_AUGM01000008.1 | 29221 | 83548 | WP_053387132.1 | 82811 | 80910 | - |
| NZ_AUGM01000008.1 | 57742 | 83548 | WP_053387132.1 | 82811 | 80910 | - |
| NZ_CH902601.1 | 215989 | 238175 | WP_005370417.1 | 216727 | 218574 | + |
| NZ_LNTE01000007.1 | 86371 | 101548 | WP_058119882.1 | 100812 | 98953 | - |

FIG. 102B

| NCBI Genome accession ID | Transposon startCoord | Transposon EndCoord | NCBI accession ID for TnsB | TnsB StartCoord | TnsB EndCoord | TnsB direction |
|---|---|---|---|---|---|---|
| NZ_QJJG01000019.1 | 22653 | 106032 | WP_110276361.1 | 105199 | 102704 | - |
| NZ_MAJT01000003.1 | 249701 | 272248 | WP_065591601.1 | 271510 | 269666 | - |
| NZ_MAJS01000006.1 | 250062 | 272609 | WP_065591601.1 | 271871 | 270027 | - |
| NZ_AJYT02000040.1 | 34788 | 62152 | WP_017019107.1 | 34904 | 37393 | + |
| NZ_LIZL01000007.1 | 259520 | 283009 | WP_054541713.1 | 260262 | 262127 | + |
| NZ_CCKD01000050.1 | 10899 | 47808 | WP_048668972.1 | 11659 | 13524 | + |
| NZ_MCUC01000076.1 | 63487 | 96200 | WP_102502386.1 | 95440 | 93575 | - |
| NZ_DS999339.1 | 53329 | 84030 | WP_005472985.1 | 54070 | 55935 | + |
| NZ_SLWJ01000005.1 | 129837 | 166746 | WP_048668972.1 | 165986 | 164121 | - |
| NZ_BBLD01000063.1 | 12734 | 42453 | WP_045403567.1 | 13495 | 15360 | + |
| NZ_LK934360.1 | 133 | 26203 | WP_057623761.1 | 25462 | 23597 | - |
| NZ_MCTU01000138.1 | 10708 | 37782 | WP_102538610.1 | 11448 | 13313 | + |
| NZ_SMAX01000007.1 | 112 | 26182 | WP_057623761.1 | 25441 | 23576 | - |
| NZ_SMBB01000007.1 | 207612 | 233682 | WP_057623761.1 | 208353 | 210218 | + |
| NZ_SMBF01000014.1 | 110 | 26180 | WP_057623761.1 | 25439 | 23574 | - |
| NZ_SODC01000006.1 | 207401 | 233471 | WP_057623761.1 | 208142 | 210007 | + |
| NZ_QEDB01000011.1 | 51671 | 80635 | WP_001134621.1 | 52412 | 54277 | + |
| NZ_VTZZ01000001.1 | 51861 | 80825 | WP_001134621.1 | 52602 | 54467 | + |
| NZ_AMBR01000012.1 | 158575 | 187539 | WP_001134621.1 | 186798 | 184933 | - |

RNA-GUIDED DNA INTEGRATION USING TN7-LIKE TRANSPOSONS

CROSS-REFERENCE TO RELATED APPLICATIONS

This application claims the benefit of U.S. Provisional Application No. 62/815,187, filed Mar. 7, 2019, U.S. Provisional Application No. 62/822,544, filed Mar. 22, 2019, U.S. Provisional Application No. 62/845,218, filed May 8, 2019, U.S. Provisional Application No. 62/855,814, filed May 31, 2019, U.S. Provisional Application No. 62/866,270, filed Jun. 25, 2019, U.S. Provisional Application No. 62/873,455, filed Jul. 12, 2019, U.S. Provisional Application No. 62/875,772, filed Jul. 18, 2019, U.S. Provisional Application No. 62/884,600, filed Aug. 8, 2019, and U.S. Provisional Application No. 62/902,171, filed Aug. Sep. 18, 2019, the contents of each of which are incorporated herein by reference.

FIELD OF THE INVENTION

The present invention relates to methods and systems for modifying DNA and other nucleic acid and for gene targeting. In particular, the present invention relates to systems and methods for genetic engineering using engineered transposon-encoded CRISPR (cluster regularly interspaced short palindromic repeats)-Cas systems.

BACKGROUND OF THE INVENTION

The CRISPR-Cas system is a prokaryotic immune system that confers resistance to foreign genetic elements such as plasmids and bacteriophages. The CRISPR/Cas9 system exploits RNA-guided DNA-binding and sequence-specific cleavage of a target DNA. A guide RNA (gRNA) is complementary to a target DNA sequence upstream of a PAM (protospacer adjacent motif) site. The Cas (CRISPR-associated) 9 protein binds to the gRNA and the target DNA and introduces a double-strand break (DSB) in a defined location upstream of the PAM site. Geurts et al., Science 325, 433 (2009); Mashimo et al., PLoS ONE 5, e8870 (2010); Carbery et al., Genetics 186, 451-459 (2010); Tesson et al., Nat. Biotech. 29, 695-696 (2011). Wiedenheft et al. Nature 482, 331-338 (2012); Jinek et al. Science 337, 816-821 (2012); Mali et al. Science 339, 823-826 (2013); Cong et al. Science 339, 819-823 (2013), all incorporated herein by reference. The ability of the CRISPR-Cas9 system to be programmed to cleave not only viral DNA but also other genes opened a new venue for genome engineering.

However, there are currently large limitations and risks associated with the use of CRISPR-Cas9 and other programmable nucleases for insertion of large gene cargos into eukaryotic genomes. Gene integration with CRISPR-Cas9 requires introduction of DSBs and the use of synthetic repair donor templates carrying appropriate designed homology arms. DSBs, which are necessary precursors for CRISPR-Cas9 mediated HDR pathways for gene integration, are known to pose hazards for cells. DSBs at off-target sites introduce off-target mutations; DSBs can provoke a DNA damage response (Haapaniemi et al., Nat. Med. 24, 927-930 (2018), incorporated herein by reference); DSBs can lead to selection for p53 null cells, which have increased risk of tumorigenesis (Ihry et al., Nat. Med. 24, 939-946 (2018), incorporated herein by reference); and DSB repair at on-target sites can cause large-scale gene deletions, inversions, or chromosome translocations (Kosicki et al., Nat Biotechnol. 36, 765-771 (2018), incorporated herein by reference). Homology donors work with the highest efficiency when supplied as recombinant AAV vectors or ssDNA, but these are also extremely laborious to produce (see e.g., Li et al., BioRxiv, 1-24 (2017), incorporated herein by reference). Furthermore, cloning of dsDNA donor templates with homology arms can be time-consuming and tedious.

In addition, gene integration with CRISPR-Cas9 and donor templates relies on homology-directed repair (HDR) for proper integration of the donor template. However, HDR efficiencies are known to be extremely low in many different cell types, and the DSBs that precede HDR are always repaired in heterogeneous ways across a cell population: some cells undergo HDR at one or both alleles, whereas far more cells undergo non-homologous end joining (NHEJ) at one or both alleles, which leads to small insertions or deletions being introduced at the target site (reviewed in: Pawelczak et al., ACS Chem Biol. 13, 389-396 (2018), incorporated herein by reference). This means that, across a cell population (e.g., as would be edited in a therapeutic or experimental application), only a small percentage of cells undergo the desired site-specific gene integration, whereas a far greater percentage undergoes heterogeneous repairs. The endogenous machinery for HDR is virtually absent in post-mitotic cells (i.e. non-dividing cells, which do not undergo DNA replication), such as neurons and terminally differentiated cells. Thus, there are no options for precise, targeted gene integration in these cell types.

Many gene therapy products, either commercialized or in clinical trials, use randomly integrating viruses to ferry therapeutics into the genome of patient cells (Naldini et al., Science 353, 1101-1102 (2016), incorporated herein by reference). With the present methods, these therapeutic genes are precisely integrated into known safe harbor loci within the genome, where stable expression can be assured, and risks of insertional mutagenesis are entirely avoided (Bokhoven et al., J Virol. 83, 283-294 (2009), incorporated herein by reference).

SUMMARY

The present systems and methods for RNA-guided DNA integration obviates the need to introduce DSBs, and thus precludes the above hazards. The present systems and methods have significant utility in genetic engineering, including mammalian cell genome engineering.

In some embodiments, the present disclosure provides for a system for RNA-guided DNA integration, the system comprising: (i) an engineered Clustered Regularly Interspaced Short Palindromic Repeats (CRISPR)-CRISPR associated (Cas) (CRISPR-Cas) system, where the engineered CRISPR-Cas system is derived from a Type I CRISPR-Cas system and comprises a guide RNA (gRNA), where the gRNA is specific for a target site; and, (ii) an engineered transposon system derived from a Tn7-like transposon system, where the engineered transposon system comprises TnsA, TnsB, TnsC and TnsD/TniQ.

The present disclosure provides for a method for RNA-guided DNA integration. In some embodiments, the method may comprise introducing into a cell: (i) an engineered Clustered Regularly Interspaced Short Palindromic Repeats (CRISPR)-CRISPR associated (Cas) (CRISPR-Cas), where the engineered CRISPR-Cas system is derived from a Type I CRISPR-Cas system and comprises a guide RNA (gRNA) specific for a target site; (ii) an engineered transposon system derived from a Tn7-like transposon system, where the engineered transposon system comprises TnsA, TnsB, TnsC and TnsD/TniQ; and, (iii) a donor DNA to be integrated, wherein the donor DNA comprises a cargo nucleic acid flanked by transposon end sequences; where the engineered CRISPR-Cas system binds to the target site, and where the engineered transposon system integrates the cargo DNA proximal to the target site.

The method may comprise introducing into a cell one or more or all of the components of the present system.

The present system may comprise (i) one or more vectors encoding the engineered CRISPR-Cas system, and, (ii) one or more vectors encoding the engineered transposon system, wherein the CRISPR-Cas system and the transposon system are on the same vector or on at least two different vectors.

The engineered CRISPR-Cas system may comprise Cas6, Cas7, Cas5, and Cas8. In one embodiment, the stoichiometry of Cas6, Cas7, Cas5, and Cas8 is 1:6:1:1. In some embodiments, the Cas5 and Cas8 are linked as a functional fusion protein. In some embodiments, the Cas5 and Cas8 are separate.

The CRISPR-Cas system may comprise a Type-I-F variant CRISPR-Cas system. In some embodiments, the engineered transposon system is derived from a Tn7-like transposon system of *Vibrio cholerae, Vibrio cholerae, Photobacterium iliopiscarium, Pseudoalteromonas* sp. P1-25, *Pseudoalteromonas ruthenica, Photobacterium ganghwense, Shewanella* sp. UCD-KL21, *Vibrio diazotrophicus, Vibrio* sp. 16, *Vibrio* sp. F12, *Vibrio splendidus, Aliivibrio wodanis*, and *Parashewanella spongiae*. In some embodiments, the engineered transposon system is from a bacteria selected from the group consisting of: *Vibrio cholerae* strain 4874, *Photobacterium iliopiscarium* strain NCIMB, *Pseudoalteromonas* sp. P1-25, *Pseudoalteromonas ruthenica* strain S3245, *Photobacterium ganghwense* strain JCM, *Shewanella* sp. UCD-KL21, *Vibrio cholerae* strain OYP7GO4, *Vibrio cholerae* strain M1517, *Vibrio diazotrophicus* strain 60.6 F, *Vibrio* sp. 16, *Vibrio* sp. F12, *Vibrio splendidus* strain UCD-SED10, *Aliivibrio wodanis* 06/09/160, and Parashewanella *spongiae* strain HJ039. In an exemplary embodiment, the engineered transposon system is derived from *Vibrio cholerae* Tn6677.

The engineered CRISPR-Cas system may be nuclease-deficient.

The present system may further comprise a donor DNA. The donor DNA comprises a cargo nucleic acid flanked by transposon end sequences.

The integration may be about 40 base pairs (bp) to about 60 bp, about 48 bp to about 50 bp, about 48 bp, about 49 bp, or about 50 bp, from the 3' end of the target site.

The cell may be a eukaryotic cell or a bacterial cell. The eukaryotic cell may be a mammalian cell, an avian cell, a plant cell or a fish cell. The mammalian cell may be derived from human, primate, cattle, sheep, pigs, dogs, mice or rat cells. In one embodiment, the mammalian cell is a human cell. The plant cell may be derived from rice, soybean, maize, tomato, banana, peanut, field pea, sunflower, canola, tobacco, wheat, barley, oats, potato, cotton, carnation, sorghum or lupin. The avian cell may be derived from chickens, ducks or geese.

In some embodiments, the systems and methods involve integration of the donor DNA without homologous recombination.

The target site may be adjacent to a protospacer adjacent motif (PAM).

In some embodiments, provided herein are systems for RNA-guided DNA integration, the system comprising one or more vectors encoding: a) an engineered Clustered Regularly Interspaced Short Palindromic Repeats (CRISPR)-CRISPR associated (Cas) (CRISPR-Cas) system, the engineered CRISPR-Cas system comprising: Cas5, Cas6, Cas7 and Cas8; and b) an engineered Tn7-like transposon system, the engineered Tn7-like transposon system comprising: i) TnsA, ii) TnsB, iii) TnsC, and iv) TnsD and/or TniQ.

In some embodiments, the CRISPR-cas system is a Type I-B CRISPR-cas system. In some embodiments, the CRISPR-cas system is a Type I-F CRISPR-cas system. In some embodiments, the CRISPR-cas system is a Type I-F variant where the Cas8 and Cas5 form a Cas8-Cas5 fusion. In some embodiments, the TnsD or TniQ comprises TniQ. In some embodiments, the systems further comprise a guide RNA (gRNA), wherein the gRNA is specific for a target site. In some embodiments, the systems further comprise a donor DNA to be integrated, wherein the donor DNA comprises a cargo nucleic acid sequence and first and second transposon end sequences, wherein the cargo nucleic acid sequence is flanked by the first and second transposon end sequences.

In some embodiments, the first and second transposon end sequences are Tn7 transposon end sequences. In some embodiments, the CRISPR-Cas system and the Tn7-like transposon system are on the same vector. In some embodiments, the engineered Tn7-like transposon system is derived from *Vibrio cholerae* Tn6677. In some embodiments, the engineered CRISPR-Cas system is nuclease-deficient. In some embodiments, the one or more vectors are plasmids.

In certain embodiments, the at least one cas protein of the CRISPR-cas system is derived from a Type V CRISPR-cas system. In some embodiments, the at least one cas protein is C2c5. In some embodiments, the at least one cas protein of the CRISPR-cas system is derived from a Type II-A CRISPR-cas system, and wherein the at least one Cas protein is Cas9. In some embodiments, the engineered CRISPR-cas system and said engineered transposon system are from a Type I CRISPR-cas system and transposon system, and wherein said system further comprises a second engineered CRISPR-cas system and a second engineered transposon system, both of which are from a Type V CRISPR-cas system and transposon system.

In some embodiments, provided herein are methods for RNA-guided DNA integration comprising: introducing into a cell: i) an engineered CRISPR-Cas system, and/or one or more vectors encoding the engineered CRISPR-Cas system, ii) an engineered transposon system, and/or one or more vectors encoding the engineered transposon system, and iii) a donor sequence comprising cargo nucleic acid sequence and first and second transposon end sequences, wherein, when one or more vectors are employed, the CRISPR-Cas system and the transposon system are on the same or different vector(s), wherein the cell comprises a nucleic acid sequence with a target site, wherein the CRISPR-cas system comprises: (a) at least one cas protein, and (b) a guide RNA (gRNA), wherein the CRISPR-cas system binds to a target site, and wherein the transposon system integrates the donor sequence downstream of the target site.

In some embodiments, the at least one Cas protein comprises Cas5, Cas6, Cas7, and Cas8. In some embodiments, the at least one Cas protein is derived from a Type I CRISPR-Cas system. In some embodiments, the at least one Cas protein comprises Cas5, Cas6, Cas7, and Cas8. In some embodiments, the Type I CRISPR-Cas system is Type I-B or Type I-F. In some embodiments, the Type I CRISPR-Cas system is a Type I-F variant where the Cas8 and the Cas5 form a Cas8-Cas5 fusion. In some embodiments, the transposon system comprises TnsA, TnsB, and TnsC. In some embodiments, the transposon system is derived from a Tn7-like transposon system.

In some embodiments, the transposon system comprises TnsA, TnsB, and TnsC. In some embodiments, the Tn7 transposon system is derived from *Vibrio choleraea*. In some embodiments, the transposon system comprises: i) TnsA, TnsB, and TnsC, and ii) TnsD and/or TniQ. In some embodiments, the at least one Cas protein of the CRISPR-Cas system is derived from a Type V CRISPR-Cas system. In some embodiments, the at least one Cas protein is C2c5. In some embodiments, the at least one Cas protein of the CRISPR-Cas system is derived from a Type II-A CRISPR-cas system. In some embodiments, the at least one Cas protein is Cas9. In some embodiments, the one or more vectors are plasmids (e.g., only one plasmid). In some embodiments, the engineered CRISPR-cas system and said engineered transposon system are from a Type I CRISPR-cas system and transposon system, and wherein said system further comprises a second engineered CRISPR-cas system and a second engineered transposon system, both of which are from a Type V CRISPR-cas system and transposon system.

In some embodiments, provided herein are systems for RNA-guided DNA integration, the system comprising one or more vectors encoding: a) an engineered Clustered Regularly Interspaced Short Palindromic Repeats (CRISPR)-CRISPR associated (Cas) (CRISPR-Cas) system, the engineered CRISPR-Cas system comprising: Cas5, Cas6, Cas7 and Cas8; and b) an engineered Tn7-like transposon system, the engineered Tn7-like transposon system comprising: i) TnsA, ii) TnsB, iii) TnsC, and iv) TnsD and/or TniQ.

In some embodiments, the CRISPR-Cas system is a Type I-B or Type I-F CRISPR-cas system. In some embodiments, the CRISPR-Cas system is a Type I-F variant where the Cas8 and the Cas5 form a Cas8-Cas5 fusion. In some embodiments, the Cas5 and Cas8 are expressed as separate non-fused proteins. In some embodiments, the one or more vectors are plasmids.

In some embodiments, the systems further comprise a guide RNA (gRNA), wherein the gRNA is specific for a target site. In some embodiments, the systems further comprise a donor DNA to be integrated, wherein the donor DNA comprises a cargo nucleic acid sequence and first and second transposon end sequences, and wherein the cargo nucleic acid sequence is flanked by the first and second transposon end sequences. In some embodiments, the donor DNA is at least 2 kb in length (e.g., 2 kb . . . 5 kb . . . 10 kb . . . or more). In certain embodiments, the CRISPR-Cas system and the Tn7-like transposon system are on the same vector. In some embodiments, the engineered Tn7-like transposon system is derived from *Vibrio cholerae* Tn6677. In some embodiments, the engineered CRISPR-Cas system is nuclease-deficient.

In some embodiments, provided herein are methods for RNA-guided DNA integration, wherein the method comprises introducing into a cell: a) one or more vectors encoding an engineered transposon-encoded CRISPR-Cas system comprising: i) an engineered Clustered Regularly Interspaced Short Palindromic Repeats (CRISPR)-CRISPR associated (Cas) (CRISPR-Cas) system, the engineered CRISPR-Cas system comprising: A) Cas5, Cas6, Cas7, and Cas8, and B) a guide RNA (gRNA), wherein the gRNA is specific for a target site; and ii) an engineered Tn7-like transposon system, the engineered Tn7-like transposon system comprising: A) TnsA, B) TnsB, C) TnsC, and D) TnsD and/or TniQ; and b) a donor DNA to be integrated, wherein the donor DNA comprises a cargo nucleic acid sequence and first and second transposon end sequences, and wherein the cargo nucleic acid sequence is flanked by the first and second transposon end sequences, and wherein the engineered transposon-encoded CRISPR-Cas system integrates the donor DNA proximal to the target site, and wherein the transposon-encoded CRISPR-Cas system and the donor DNA are on the same vector or on at least two different vectors.

In some embodiments, the CRISPR-cas system is a Type I-B or Type I-F CRISPR-cas system. In some embodiments, the CRISPR-cas system is a Type I-F variant where the Cas8 and Cas5 form a Cas8-Cas5 fusion. In some embodiments, the one or more vectors encode the engineered CRISPR-Cas system, wherein one or more vectors encode the engineered Tn7-like transposon system, and wherein the CRISPR-Cas system and the Tn7-like transposon system are on at least two different vectors. In some embodiments, the donor DNA is integrated about 40 base pairs (bp) to about 60 bp 3' of the target site. In some embodiments, the donor DNA is integrated about 48 bp to about 50 bp 3' of the target site. In some embodiments, the donor DNA is integrated about 50 bp 3' of the target site.

In some embodiments, the cell is a eukaryotic cell or a bacterial cell. In some embodiments, the eukaryotic cell is a human cell. In some embodiments, the engineered Tn7-like transposon system is derived from *Vibrio cholerae* Tn6677. In some embodiments, the engineered CRISPR-Cas system is nuclease-deficient. In some embodiments, the target site is adjacent to a protospacer adjacent motif (PAM). In some embodiments, provided herein is a cell with the systems described above and herein.

In some embodiments, provided herein are kits comprising: a) one or more vectors encoding: i) an engineered Clustered Regularly Interspaced Short Palindromic Repeats (CRISPR)-CRISPR associated (Cas) (CRISPR-Cas) system, the engineered CRISPR-Cas system comprising: Cas5, Cas6, Cas7 and Cas8; and ii) an engineered Tn7-like transposon system, the engineered Tn7-like transposon system comprising: A) TnsA, B) TnsB, C) TnsC, and D) TnsD and/or TniQ; and b) at least one component selected from the group consisting of: i) an infusion device, ii) an intravenous solution bag, iii) a vial having a stopper pierceable by a hypodermic needle, iv) a buffer, v) a control plasmid, and vi) sequencing primers.

In some embodiments, the one or more vectors are plasmids. In some embodiments, the Cas5 and Cas8 are expressed as separate non-fused proteins. In some embodiments, the CRISPR-Cas system is a Type I-F variant where the Cas8 and the Cas5 form a Cas8-Cas5 fusion. In some embodiments, the kits further comprise a donor nucleic acid sequence, wherein the donor nucleic acid sequences comprise a cargo nucleic acid sequence and first and second transposon end sequences.

In some embodiments, provided herein are methods for inactivating a microbial gene, the method comprising introducing into one or more cells: a) an engineered transposon-encoded CRISPR-Cas system, and/or b) one or more vectors encoding the engineered transposon-encoded CRISPR-Cas system, wherein the transposon encoded CRISPR-Cas system comprises: i) at least one Cas protein, ii) a guide RNA (gRNA) specific for a target site that is proximal to the microbial gene, iii) an engineered transposon system, and iv) a donor DNA, wherein the transposon-encoded CRISPR-Cas system inserts the donor DNA within the microbial gene.

In some embodiments, the microbial gene is a bacterial antibiotic resistance gene, a virulence gene, or a metabolic gene. In some embodiments, the donor DNA comprises a cargo nucleic acid sequence and first and second transposon end sequences. In some embodiments, the cargo nucleic acid sequence encodes the engineered transposon encoded CRISPR-Cas system.

In some embodiments, the one or more cells are bacterial cells, and wherein the introducing comprises contacting an initial cell containing the transposon-encoded CRISPR-Cas system with a recipient cell such that the transposon-encoded CRISPR-Cas system is passed to the recipient cell via bacterial conjugation.

In some embodiments, the at least one Cas protein comprises Cas5, Cas6, Cas7, and Cas8. In some embodiments, the at least one Cas protein is derived from a Type I CRISPR-cas system. In some embodiments, the at least one Cas protein comprises Cas5, Cas6, Cas7, and Cas8. In some embodiments, the Type I CRISPR-cas system is Type I-B or Type I-F. In some embodiments, the Type I CRISPR-cas system is a Type I-F variant where the Cas8 and Cas5 form a Cas8-Cas5 fusion.

In some embodiments, the transposon system comprises TnsA, TnsB, and TnsC. In some embodiments, the transposon system is derived from a Tn7 transposon system. In some embodiments, the transposon system comprises TnsA, TnsB, and TnsC. In some embodiments, the Tn7 transposon system is derived from *Vibrio cholerae*. In some embodiments, the transposon system comprises: i) TnsA, TnsB, and TnsC, and ii) TnsD and/or TniQ. In some embodiments, the at least one Cas protein of the CRISPR-Cas system is derived from a Type V CRISPR-cas system. In some embodiments, the at least one Cas protein is C2c5. In some embodiments, the at least one Cas protein of the CRISPR-cas system is derived from a Type II-A CRISPR-Cas system. In some embodiments, the at least one Cas protein is Cas9. In some embodiments, the engineered CRISPR-cas system and said engineered transposon system are from a Type I CRISPR-cas system and transposon system, and wherein said system further comprises a second engineered CRISPR-cas system and a second engineered transposon system, both of which are from a Type V CRISPR-cas system and transposon system.

In some embodiments, provided herein are methods comprising: a) contacting a sample with: i) an engineered transposon-encoded CRISPR-Cas system, and/or ii) one or more vectors encoding the engineered transposon-encoded CRISPR-Cas system, wherein the sample comprises an input nucleic acid sequence comprising: A) a double stranded nucleic acid sequence of interest (NASI), B) a double stranded first flanking region on one side of the NASI, and C) a double stranded second flanking region on the other side of the NASI, and wherein the transposon-encoded CRISPR-Cas system comprises: i) at least one Cas protein, ii) an engineered transposon system; iii) a first left transposon end sequence; iv) a first right transposon end sequence which is not covalently attached to the first left transposon end sequence; and v) a first guide RNA (gRNA-1) targeting the first left and first right transposon end sequences to the first flanking region, and b) incubating the sample under conditions such that the first left transposon end sequence and the first right transposon end sequence are integrated into the first flanking region.

In some embodiment, provided herein are methods comprising: a) contacting a sample with: i) an engineered transposon-encoded CRISPR-Cas system, and/or ii) one or more vectors encoding the engineered transposon-encoded CRISPR-Cas system, wherein the sample comprises an input nucleic acid sequence comprising: A) a double stranded nucleic acid sequence of interest (NASI), B) a double stranded first flanking region on one side of the NASI, and C) a double stranded second flanking region on the other side of the NASI, and wherein the transposon-encoded CRISPR-Cas system comprises: i) at least one Cas protein, ii) an engineered transposon system; iii) a first left transposon end sequence; iv) a first right transposon end sequence which is not covalently attached to the first left transposon end sequence; v) a second left transposon end sequence; vi) a second right transposon end sequence which is not covalently attached to the second left transposon end sequence; vii) a first guide RNA (gRNA-1) targeting the first left and first right transposon end sequences to the first flanking region, and viii) a second guide RNA (gRNA-2) targeting the second left and second right transposon end sequences to the second flanking region; and b) incubating the sample under conditions such that: i) the first left transposon end sequence and the first right transposon end sequence are integrated into the first flanking region, and ii) the second left transposon end sequence and the second right transposon end sequence are integrated into the second flanking region.

In some embodiments, the methods further comprise: c) contacting the sample with: i) a first primer specific for the first left or right transposon end sequence, ii) a second primer specific for the second left or right transposon end sequence, and iii) a polymerase; and d) treating the sample under amplification conditions such that the NASI is amplified thereby generating amplified NASI. In some embodiments, the methods further comprise: e) sequencing the amplified NASI. In some embodiments, the sequencing is next-generation sequencing (NGS).

In some embodiments, the first transposon left or right end sequence comprises a first adapter sequence, and the second transposon left or right end sequence comprises a second adapter sequence. In some embodiments, the methods further comprise: c) contacting the sample with: i) a first primer specific for the first adapter sequence, ii) a second primer specific for the second adapter sequence, and iii) a polymerase; and d) treating the sample under amplification conditions such that the NASI is amplified thereby generating amplified NASI. In some embodiments, the methods further comprise: e) sequencing the amplified NASI. In some embodiments, the sequencing is next-generation sequencing (NGS). In some embodiments, the first and second adapter sequences are next-generation sequencing adapters. In some embodiments, the transposon left end sequence comprises a first UMI sequence, and the transposon right end sequence comprises a second UMI sequence.

In some embodiments, the at least one Cas protein comprises Cas5, Cas6, Cas7, and Cas8. In some embodiments, the at least one Cas protein is derived from a Type I CRISPR-cas system. In some embodiments, the at least one Cas protein comprises Cas5, Cas6, Cas7, and Cas8. In some embodiments, the Type I CRISPR-cas system is Type I-B or Type I-F. In some embodiments, the Type I CRISPR-cas system is a Type I-F variant where the Cas8 and Cas5 form a Cas8-Cas5 fusion. In some embodiments, the transposon system comprises TnsA, TnsB, and TnsC. In some embodiments, the transposon system is derived from a Tn7-like transposon system. In some embodiments, the transposon system comprises TnsA, TnsB, and TnsC.

In some embodiments, the Tn7 transposon system is derived from *Vibrio choleraea*. In some embodiments, the transposon system comprises: i) TnsA, TnsB, and TnsC, and ii) TnsD and/or TniQ. In some embodiments, the at least one Cas protein of the CRISPR-Cas system is derived from a Type V CRISPR-cas system. In some embodiments, the at least one Cas protein is C2c5. In some embodiments, the at least one Cas protein of the CRISPR-cas system is derived from a Type II-A CRISPR-Cas system. In some embodiments, the at least one Cas protein is Cas9. In some embodiments, the engineered CRISPR-cas system and said engineered transposon system are from a Type I CRISPR-cas system and transposon system, and wherein said system further comprises a second engineered CRISPR-cas system and a second engineered transposon system, both of which are from a Type V CRISPR-cas system and transposon system.

In some embodiments, provided herein are methods for RNA-guided DNA integration in a plant cell comprising: introducing into a plant cell: a) an engineered transposon-encoded CRISPR-Cas system, and/or ii) one or more vectors encoding the engineered transposon-encoded CRISPR-Cas system, wherein the transposon-encoded CRISPR-Cas system comprises: i) at least one Cas protein, ii) a guide RNA (gRNA) specific for a target site, iii) an engineered transposon system, and iv) a donor DNA, wherein the transposon-encoded CRISPR-Cas system integrates the donor DNA proximal to a target nucleic acid site in the plant cell.

In some embodiments, the plant cell is a cell of rice, soybean, maize, tomato, banana, peanut, field pea, sunflower, canola, tobacco, wheat, barley, oats, potato, cotton, carnation, sorghum, lupin, *Solanum lycopersicum, Glycine max, Arabidopsis thaliana, Medicago truncatula, Brachypodium distachyon, Oryza sativa, Sorghum bicolor, Zea mays*, or *Solanum tuberosum*. In some embodiments, the plants cell is of *Petunia*, the genus *Atropa*, Rutabaga, Celery, Switchgrass, Apple, *Nicotiana benthamiana*, or *Setaria viridis*. In some embodiments, the plant cell is a cell of a monocot or dicot plant.

In some embodiments, the integration of the donor DNA confers a change in one or more of the following traits to the plant cell: grain number, grain size, grain weight, panicle size, tiller number, fragrance, nutritional value, shelf life, lycopene content, starch content and/or ii) lower gluten content, reduced levels of a toxin, reduced levels of steroidal glycoalkaloids, a substitution of mitosis for meiosis, asexual propagation, improved haploid breeding, and/or shortened growth time. In some embodiments, the integration of the donor DNA confers one or more of the following traits to the plant cell: herbicide tolerance, drought tolerance, male sterility, insect resistance, abiotic stress tolerance, modified fatty acid metabolism, modified carbohydrate metabolism, modified seed yield, modified oil percent, modified protein percent, resistance to bacterial disease, resistance to fungal disease, and resistance to viral disease.

In some embodiments, the transposon-encoded CRISPR-Cas system integrates the donor DNA into the genome of the plant cell. In some embodiments, the one or more vectors encoding the transposon-encoded CRISPR-Cas system are introduced into the plant cell via *Agrobacterium*-mediated transformation of the plant cell.

In some embodiments, the donor DNA comprises first and second transposon end sequences. In some embodiments, the transposon system is a bacterial Tn7-like transposon system. In some embodiments, the transposon-encoded CRISPR-Cas system comprises TnsD and/or TniQ. In some embodiments, the transposon-encoded CRISPR-Cas system comprises TnsA, TnsB, and TnsC. In some embodiments, the transposon-encoded CRISPR-Cas system is nuclease-deficient. In some embodiments, the transposon-encoded CRISPR-Cas system is derived from a Type I CRISPR-Cas system. In some embodiments, the transposon-encoded CRISPR-Cas system comprises a Cascade complex.

In some embodiments, the transposon-encoded CRISPR-Cas system is derived from a Type II CRISPR-Cas system. In some embodiments, the transposon-encoded CRISPR-Cas system is derived from a Type V CRISPR-Cas system. In some embodiments, the transposon-encoded CRISPR-Cas system comprises C2c5. In some embodiments, the target site is flanked by a protospacer adjacent motif (PAM). In some embodiments, the donor DNA is integrated about 46-bp to 55-bp downstream of the target site. In some embodiments, the donor DNA is integrated about 47-bp to 51-bp downstream of the target site.

In certain embodiments, provided herein are modified plant cells produced by the methods described above and herein. In certain embodiments, provided herein are plants or seed comprising such plant cells. In some embodiments, provided herein are fruits, plant parts, or propagation materials of such plants.

In some embodiments, provided herein are methods for RNA-guided DNA integration in an animal cell comprising: introducing into an animal cell: a) an engineered transposon-encoded CRISPR-Cas system, and/or ii) one or more vectors encoding the engineered transposon-encoded CRISPR-Cas system, wherein the transposon-encoded CRISPR-Cas system comprises: i) at least one Cas protein, ii) a guide RNA (gRNA) specific for a target site, iii) an engineered transposon system, and iv) a donor DNA, wherein the transposon-encoded CRISPR-Cas system integrates the donor DNA proximal to a target site in the animal cell.

In some embodiments, the animal cell is a cell of a cell of a mouse, a rat, a rabbit, cattle, a sheep, a pig, a chicken, a horse, a buffalo, a camel, a turkey, or a goose. In some embodiments, the animal cell is a cell of a mammal. In some embodiments, the mammal is an orangutan, a monkey, a horse, cattle, a sheep, a goat, a pig, a donkey, a dog, a rabbit, a cat, a rat or a mouse. In some embodiments, the animal cell is a cell of a livestock animal. In some embodiments, the transposon-encoded CRISPR-Cas system integrates the donor DNA into the genome of the animal cell.

In some embodiments, the donor DNA comprises transposon end sequences. In some embodiments, the transposon system is a bacterial Tn7-like transposon system. In some embodiments, the transposon-encoded CRISPR-Cas system comprises TnsD and/or TniQ. In some embodiments, the transposon-encoded CRISPR-Cas system comprises TnsA, TnsB, and TnsC. In some embodiments, the transposon-encoded CRISPR-Cas system is nuclease-deficient. In some embodiments, the transposon-encoded CRISPR-Cas system is derived from a Type I CRISPR-Cas system. In some embodiments, the transposon-encoded CRISPR-Cas system comprises a Cascade complex. In some embodiments, the transposon-encoded CRISPR-Cas system is derived from a Type II CRISPR-Cas system. In some embodiments, the transposon-encoded CRISPR-Cas system is derived from a Type V CRISPR-Cas system. In some embodiments, the transposon-encoded CRISPR-Cas system comprises C2c5. In some embodiments, the target site is flanked by a protospacer adjacent motif (PAM). In some embodiments, the donor DNA is integrated about 46-bp to 55-bp downstream of the target site. In some embodiments, the donor DNA is integrated about 47-bp to 51-bp downstream of the target site. In some embodiments, the Tn7-like transposon system is derived from *Vibrio cholerae*.

In some embodiments, provided herein are modified non-human animal cells produced by the method described above and herein. In some embodiments, provided herein are genetically modified non-human animals comprising such animal cells. In some embodiments, provided herein are populations of cells, tissues, or organs comprising such animal cells.

In some embodiments, provided herein are compositions comprising: a) an engineered transposon-encoded CRISPR-Cas system, and/or b) one or more nucleic acid sequence(s) encoding the engineered transposon-encoded CRISPR-Cas system, wherein the engineered transposon-encoded CRISPR-Cas system comprises: i) at least one Cas protein, ii) a guide RNA (gRNA) specific for a target site in human DNA, iii) an engineered transposon system, and iv) a donor nucleic acid comprising a cargo nucleic acid sequence and first and second transposon end sequences, wherein the cargo nucleic acid sequence is flanked by the first and second transposon end sequences.

In some embodiments, provided herein are kits comprising: a) the above composition, and b) a device for holding the composition. In some embodiments, the device is selected from the group consisting of: an infusion device, an intravenous solution bag, and a vial having a stopper pierceable by a hypodermic needle.

In some embodiments, provided herein are methods of treating a subject (e.g., a human) comprising: a) administering (e.g., intravenously) one or more compositions to a mammalian subject that comprises subject cells and microbiome cells, wherein the one or more compositions comprise: i) an engineered transposon-encoded CRISPR-Cas system, and/or ii) one or more nucleic acid sequence(s) encoding the engineered transposon-encoded CRISPR-Cas system, wherein the transposon-encoded CRISPR-Cas system comprises: i) at least one Cas protein, ii) a guide RNA (gRNA) specific for a target site in the genome of the subject cells or the genome of the microbiome cells, iii) an engineered transposon system, and iv) a donor nucleic acid comprising a cargo nucleic acid sequence and first and second transposon end sequences, wherein the cargo nucleic acid sequence is flanked by the first and second transposon end sequences, wherein the transposon-encoded CRISPR-Cas system integrates the donor nucleic acid proximal to a target site in the genome in at least one of the subject cells, and/or in the genome of the at least one of the microbiome cells.

In certain embodiments, provided herein are methods of treating a cell in vitro comprising: a) contacting at least one cell in vitro with a composition that comprises: i) an engineered transposon-encoded CRISPR-Cas system, and/or ii) one or more nucleic acid sequence(s) encoding the engineered transposon-encoded CRISPR-Cas system, wherein the transposon-encoded CRISPR-Cas system comprises: i) at least one Cas protein, ii) a guide RNA (gRNA) specific for a target site in the genome of the cell, iii) an engineered transposon system, and iv) a donor nucleic acid sequence comprising a cargo nucleic acid sequence and first and second transposon end sequences, wherein the cargo nucleic acid sequence is flanked by the first and second transposon end sequences, and wherein the transposon-encoded CRISPR-Cas system integrates the donor nucleic acid proximal to a target site in the genome of at least one cell.

In some embodiments, provided herein are methods for RNA-guided nucleic acid integration in a cell comprising: a) introducing into a population of cells: i) an engineered transposon-encoded CRISPR-Cas system, and/or ii) one or more nucleic acid sequence(s) encoding the engineered transposon-encoded CRISPR-Cas system, wherein the engineered transposon-encoded CRISPR-Cas system comprises: A) at least one Cas protein, B) a guide RNA (gRNA) specific for a target site in the genome of the cell, C) an engineered transposon system, and D) a donor nucleic acid that is at least 2 kb in length, wherein the donor nucleic acid sequence comprises a cargo nucleic acid sequence and first and second transposon end sequences, wherein the cargo nucleic acid sequence is flanked by the first and second transposon end sequences; and b) culturing the cells under conditions such that the transposon-encoded CRISPR-Cas system integrates the donor nucleic acid sequence proximal to the target site in the genome of the cell. In some embodiments, the donor nucleic acid sequence is at least 10 kb in length, at least 50 kb in length, at least 100 kb in length, or between 20-60 kb in length. In some embodiments, the cells are bacterial cells and the conditions comprise culturing the bacterial cells at least 5 degrees Celsius below optimal growth temperature for the bacterial cells. In some embodiments, the bacterial cells are E. coli cells, and wherein the E. coli cells are cultured at temperature of 30 degrees Celsius or lower.

In some embodiments, the cell is a human cell, a plant cell, a bacterial cell, or an animal cell. In some embodiments, the one or more nucleic acid sequence(s) comprises one or vectors. In some embodiments, the one or more nucleic acid sequence(s) comprises at least one mRNA sequence.

In some embodiments, the subject is a human. In some embodiments, the subject is a human with a disease selected from the group consisting of: cancer, Duchenne muscular dystrophy (DMD), sickle cell disease (SCD), β-thalassemia, and hereditary tyrosinemia type I (HT1). In some embodiments, the cargo nucleic acid sequence comprises a therapeutic sequence.

In some embodiments, the transposon-encoded CRISPR-Cas system integrates the donor nucleic acid sequence using a cut-and-paste transposition pathway. In some embodiments, the at least one Cas protein comprises Cas5, Cas6, Cas7, and Cas8. In some embodiments, the at least one Cas protein comprises Cas5, Cas6, Cas7, and Cas8; and the engineered transposon system comprises: i) TnsA, ii) TnsB, iii) TnsC, and iv) TniQ. In some embodiments, at least one of the following applies: I) wherein the Cas5 and Cas8 form a Cas5-Cas8 fusion protein; II) wherein the TniQ and Cas6 form a TniQ-Cas6 fusion protein; and/or III) the TnsA and TnsB form a TnsA-TnsB fusion protein. In some embodiments, the TniQ is fused to the at least one Cas protein, generating a TniQ-Cas fusion polypeptide. In some embodiments, the at least one Cas protein is Cas6.

In some embodiments, the at least one Cas protein is derived from a Type I CRISPR-Cas system. In some embodiments, the at least one Cas protein comprises Cas5, Cas6, Cas7, and Cas8. In some embodiments, the Type I CRISPR-Cas system is Type I-B or Type I-F. In some embodiments, the Type I CRISPR-Cas system is a Type I-F variant where the Cas8 and Cas5 form a Cas8-Cas5 fusion. In some embodiments, the transposon system comprises TnsA, TnsB, and TnsC. In some embodiments, the engineered transposon system comprises: i) TnsA, ii) TnsB, iii) TnsC, and iv) TnsD and/or TniQ. In some embodiments, the TnsA and TnsB are expressed as a TnsA-TnsB fusion protein. In some embodiments, the engineered transposon system comprises: i) TnsA, ii) TnsB, iii) TnsC, and iv) a TniQ family protein.

In some embodiments, the methods, compositions, and kits further comprise a second guide RNA (gRNA-2), wherein the gRNA-2 directs the donor DNA to integrate proximal to a second and distinct target site. In some embodiments, the methods, compositions, and kits further comprise a third guide RNA (gRNA-3), wherein the gRNA-3 directs the donor DNA to integrate proximal to a third and distinct target site.

In some embodiments, the transposon system is derived from a Tn7-like transposon system. In some embodiments, the Tn7 transposon system is derived from *Vibrio choleraea*. In some embodiments, the at least one Cas protein of the CRISPR-cas system is derived from a Type V CRISPR-cas system. In some embodiments, the at least one Cas protein comprises C2c5. In some embodiments, the engineered transposon-encoded CRISPR-Cas system is from *Scytonema hofmannii* PCC 7110. In some embodiments, the at least one Cas protein of the CRISPR-cas system is derived from a Type II-A CRISPR-cas system. In some embodiments, the at least one Cas protein is Cas9. In some embodiments, the engineered CRISPR-cas system and the engineered transposon system are from a Type I CRISPR-cas system and transposon system, and wherein said system further comprises a second engineered CRISPR-cas system and a second engineered transposon system, both of which are from a Type V CRISPR-cas system and transposon system.

In some embodiments, the donor nucleic acid is at least 2 kb in length. In some embodiments, the donor nucleic acid is at least 10 kb in length. In some embodiments, the one or more nucleic acid sequences are one or more viral vectors selected from the group consisting of: retroviral, lentiviral, adenoviral, adeno-associated and herpes simplex viral vectors. In some embodiments, the one or more nucleic acid sequence(s) further comprises one or more one promoters. In some embodiments, the one or more nucleic acid sequences is one and only one vector. In some embodiments, the one vector comprises one and only one promoter.

In some embodiments, the at least one Cas protein comprises Cas5, Cas6, Cas7, and Cas8. In some embodiments, the at least one Cas protein comprises Cas5, Cas6, Cas7, and Ca8, and wherein the Cas5 and Cas8 form a fusion protein. In some embodiments, the first transposon end sequence is a left transposon end sequence, and wherein the second transposon end sequence is a right transposon end sequence.

In some embodiments, the left and/or right transposon end sequence is a variant sequence that increase the efficiency of integration of the donor nucleic acid sequence compared to corresponding wild-type left and/or right transposon end sequences. In some embodiments, the left and/or right transposon end sequence alter the orientation bias of the donor nucleic acid sequence when integrated proximal to the target site in the genome as compared to corresponding wild-type left and/or right transposon end sequences. In some embodiments, the orientation bias favors tRL. In some embodiments, the orientation bias favors tLR.

In some embodiments, the first and/or second transposon end sequences code for a functional protein linker sequence. In some embodiments, the genome of the subject cells or microbiome cells comprises a target-protein encoding gene, wherein the cargo nucleic acid sequence encodes an amino acid sequence of interest, and wherein the donor nucleic acid sequence is inserted adjacent to or within the target protein-encoding gene to generate a fusion-protein encoding sequence, wherein the fusion protein comprises the amino acid sequence of interest appended to the target protein. In some embodiments, the amino acid sequence of interest is selected from the group consisting of: a fluorescent protein, an epitope tag, and a degron tag.

In some embodiments, the genome of the cells or microbiome cells comprises a target-protein encoding gene, wherein the cargo nucleic acid sequence comprises: i) an amino acid sequence of interest encoding region (AASIER), ii) splice acceptor and/or donor sites that flank the AASIER, and wherein the donor nucleic acid sequence is inserted adjacent to or within the target protein-encoding gene to generate a synthetic engineered exon that enables in-frame tagging of the target protein with the amino acid sequence of interest.

In some embodiments, the engineered transposon-encoded CRISPR-Cas system is from a bacteria selected from the group consisting of: *Vibrio cholerae, Photobacterium iliopiscarium, Pseudoalteromonas* sp. P1-25, *Pseudoalteromonas ruthenica, Photobacterium ganghwense, Shewanella* sp. UCD-KL21, *Vibrio diazotrophicus, Vibrio* sp. 16, *Vibrio* sp. F12, *Vibrio splendidus, Aliivibrio wodanis*, and *Parashewanella spongiae*. In some embodiments, the engineered transposon-encoded CRISPR-Cas system is from a bacteria selected from the group consisting of: *Vibrio cholerae* strain 4874, *Photobacterium iliopiscarium* strain NCIMB, *Pseudoalteromonas* sp. P1-25, *Pseudoalteromonas ruthenica* strain S3245, *Photobacterium ganghwense* strain JCM, *Shewanella* sp. UCD-KL21, *Vibrio cholerae* strain OYP7GO4, *Vibrio cholerae* strain M1517, *Vibrio diazotrophicus* strain 60.6 F, *Vibrio* sp. 16, *Vibrio* sp. F12, *Vibrio splendidus* strain UCD-SED10, *Aliivibrio wodanis* 06/09/160, and *Parashewanella spongiae* strain HJ039.

In some embodiments, the cargo nucleic acid sequence comprises an element selected from the group consisting of: a natural transcription promoter element, a synthetic transcriptional promoter element, an inducible transcriptional promoter element, a constitutive transcriptional promoter element, a natural transcriptional termination element, a synthetic transcriptional termination element, an origin of replication, a replication termination sequence, a centromeric sequence, and a telomeric sequence. In some embodiments, the cargo nucleic acid sequence encodes at least one of the following: a therapeutic protein, a metabolic pathway, and/or a biosynthetic pathway.

In some embodiments, provided herein are methods of treating a cell comprising: a) contacting at least one cell with a composition that comprises: i) an engineered transposon-encoded CRISPR-Cas system, and/or ii) one or more nucleic acid sequence(s) encoding the engineered transposon-encoded CRISPR-Cas system, wherein the transposon-encoded CRISPR-Cas system comprises: i) at least one Cas protein, ii) at least one guide RNA (gRNA) specific for a target site in the genome of the at least one cell, iii) an engineered transposon system, and iv) a donor nucleic acid sequence comprising a cargo nucleic acid sequence and first and second transposon end sequences, wherein the cargo nucleic acid sequence is flanked by the first and second transposon end sequences, and wherein the cargo nucleic acid is at least 2 kb (e.g., 2 kb . . . 5 kb . . . 50 kb . . . 100 kb . . . or more) in length, and wherein the transposon-encoded CRISPR-Cas system integrates the donor nucleic acid proximal to the target site in the genome of the at least one cell.

In some embodiments, provided herein are compositions comprising: i) an engineered transposon-encoded CRISPR-Cas system, and/or ii) one or more nucleic acid sequence(s) encoding the engineered transposon-encoded CRISPR-Cas system, wherein the transposon-encoded CRISPR-Cas system comprises: a) at least one Cas protein, b) at least one guide RNA (gRNA) specific for a target site in the genome of at least one cell, c) an engineered transposon system, and d) a donor nucleic acid sequence comprising a cargo nucleic acid sequence and first and second transposon end sequences, wherein the cargo nucleic acid sequence is flanked by the first and second transposon end sequences, and wherein the cargo nucleic acid is at least 2 kb (e.g., 2 kb . . . 5 kb . . . 50 kb . . . 100 kb . . . or more) in length.

In some embodiments, provided herein are compositions comprising: a self-transposable nucleic acid sequence comprising: a) a mobile nucleic acid sequence encoding a transposon-encoded CRISPR-Cas system, and b) first and second transposon end sequences that flank the mobile nucleic acid sequence, wherein the transposon-encoded CRISPR-Cas system comprises: i) at least one Cas protein, ii) a guide RNA (gRNA) specific for a target site, and iii) an engineered transposon system.

In some embodiments, provided herein are methods for targeting a cancer cell comprising: introducing into a cancer cell: i) an engineered transposon-encoded CRISPR-Cas system, and/or ii) one or more nucleic acid sequence(s) encoding the engineered transposon-encoded CRISPR-Cas system, wherein the engineered transposon-encoded CRISPR-Cas system comprises: A) at least one Cas protein, B) a guide RNA (gRNA) specific for a target site in the genome of the cancer cell, C) an engineered transposon system, and D) a donor nucleic acid sequence comprising first and second transposon end sequences. In certain embodiments, the introducing is under conditions such that the transposon-encoded CRISPR-Cas system integrates the donor nucleic acid sequence proximal to the target site in the genome of the cancer cell. In some embodiments, the target site is in a genomic sequence associated with an oncogene. In some embodiments, the donor nucleic acid disrupts pathogenic expression of an oncogene.

In some embodiments, the compositions further comprise a vector, and wherein the self-transposable nucleic acid sequence is present in the vector. In some embodiments, the compositions further comprise a cell having genomic DNA, and wherein the self-transposable nucleic acid sequence is present in the genomic DNA.

In some embodiments, the at least one Cas protein comprises Cas5, Cas6, Cas7, and Cas8. In some embodiments, the at least one Cas protein is derived from a Type I CRISPR-cas system. In some embodiments, the at least one Cas protein comprises Cas5, Cas6, Cas7, and Cas8. In some embodiments, the Type I CRISPR-cas system is Type I-B or Type I-F. In some embodiments, the Type I CRISPR-cas system is a Type I-F variant where the Cas8 and the Cas5 form a Cas8-Cas5 fusion. In some embodiments, the transposon system comprises TnsA, TnsB, and TnsC. In some embodiments, the engineered transposon system comprises: i) TnsA, ii) TnsB, iii) TnsC, and iv) TnsD and/or TniQ. In some embodiments, the TnsA and TnsB are expressed as a TnsA-TnsB fusion protein. In some embodiments, the TniQ is fused to the at least one Cas protein, generating a TniQ-Cas fusion polypeptide. In some embodiments, the at least one Cas protein is Cas6. In some embodiments, the engineered transposon system comprises: i) TnsA, ii) TnsB, iii) TnsC, and iv) a TniQ family protein.

In some embodiments, the transposon system is derived from a Tn7-like transposon system. In some embodiments, the Tn7 transposon system is derived from *Vibrio choleraea*. In some embodiments, the at least one Cas protein of the CRISPR-cas system is derived from a Type V CRISPR-cas system. In some embodiments, the at least one Cas protein is C2c5. In some embodiments, the at least one Cas protein of the CRISPR-Cas system is derived from a Type II-A CRISPR-Cas system. In some embodiments, the at least one Cas protein is Cas9. In some embodiments, the at least one Cas protein comprises Cas2, Cas3, Cas5, Cas6, Cas7, and Cas8. In some embodiments, the at least one Cas protein comprises Cas5, Cas6, Cas7, and Cas8; and the engineered transposon system comprises: i) TnsA, ii) TnsB, iii) TnsC, and iv) TniQ. In some embodiments, at least one of the following applies: I) wherein the Cas5 and Cas8 form a Cas5-Cas8 fusion protein; II) wherein the TniQ and Cas6 form a TniQ-Cas6 fusion protein; and/or III) the TnsA and TnsB form a TnsA-TnsB fusion protein.

In some embodiments, the first transposon end sequence is a left transposon end sequence, and wherein the second transposon end sequence is a right transposon end sequence. In some embodiments, the left and/or right transposon end sequence is a variant sequence that increase the efficiency of integration of the donor nucleic acid sequence compared to corresponding wild-type left and/or right transposon end sequences. In some embodiments, the left and/or right transposon end sequence alter the orientation bias of the donor nucleic acid sequence when integrated proximal to the target site in the genome as compared to corresponding wild-type left and/or right transposon end sequences. In some embodiments, the orientation bias favors tRL. In some embodiments, the orientation bias favors tLR.

In some embodiments, the first and/or second transposon end sequences code for a functional protein linker sequence. In some embodiments, the engineered transposon-encoded CRISPR-Cas system is from a bacteria selected from the group consisting of: *Vibrio cholerae, Photobacterium iliopiscarium, Pseudoalteromonas* sp. P1-25, *Pseudoalteromonas ruthenica, Photobacterium ganghwense, Shewanella* sp. UCD-KL21, *Vibrio diazotrophicus, Vibrio* sp. 16, *Vibrio* sp. F12, *Vibrio splendidus, Aliivibrio wodanis*, and *Parashewanella spongiae*. In some embodiments, the engineered transposon-encoded CRISPR-Cas system is from a bacteria selected from the group consisting of: *Vibrio cholerae* strain 4874, *Photobacterium iliopiscarium* strain NCIMB, *Pseudoalteromonas* sp. P1-25, *Pseudoalteromonas ruthenica* strain S3245, *Photobacterium ganghwense* strain JCM, *Shewanella* sp. UCD-KL21, *Vibrio cholerae* strain OYP7GO4, *Vibrio cholerae* strain M1517, *Vibrio diazotrophicus* strain 60.6 F, *Vibrio* sp. 16, *Vibrio* sp. F12, *Vibrio splendidus* strain UCD-SED10, *Aliivibrio wodanis* 06/09/160, and *Parashewanella spongiae* strain HJ039. In some embodiments, the engineered transposon-encoded CRISPR-Cas system is from *Scytonema hofmannii* PCC 7110.

In some embodiments, provided herein are methods of administering the compositions described above and herein to a subject (e.g., human). In some embodiments, provided herein are methods of contacting a cell (e.g., human cell) in vitro with the compositions described above and herein. In some embodiments, the engineered CRISPR-cas system and said engineered transposon system are from a Type I CRISPR-cas system and transposon system, and wherein said system further comprises a second engineered CRISPR-cas system and a second engineered transposon system, both of which are from a Type V CRISPR-cas system and transposon system.

In some embodiments, provided herein are methods of treating a cell comprising: a) contacting at least one cell with a composition that comprises: i) an engineered transposon-encoded CRISPR-Cas system, and/or ii) one or more nucleic acid sequence(s) encoding the engineered transposon-encoded CRISPR-Cas system, wherein the transposon-encoded CRISPR-Cas system comprises: i) at least one Cas protein, ii) at least one guide RNA (gRNA) specific for a target site in the genome of the at the least one cell, iii) an engineered transposon system, and iv) a donor nucleic acid comprising a cargo nucleic acid sequence and first and second transposon end sequences, wherein the cargo nucleic acid sequence is flanked by the first and second transposon end sequences, and wherein the transposon-encoded CRISPR-Cas system integrates the donor nucleic acid proximal to the target site in the genome of the at least one cell.

In some embodiments, provided herein are methods of treating a cell comprising: a) contacting at least one cell with a composition that comprises: i) an engineered transposon-encoded CRISPR-Cas system, and/or ii) one or more nucleic acid sequence(s) encoding the engineered transposon-encoded CRISPR-Cas system, wherein the transposon-encoded CRISPR-Cas system comprises: i) at least one Cas protein, ii) an engineered transposon system, and iii) a donor nucleic acid sequence comprising a cargo nucleic acid sequence and first and second transposon end sequences, wherein the cargo nucleic acid sequence is flanked by the first and second transposon end sequences, and wherein at least part of the cargo nucleic acid sequence encodes at least one guide RNA (gRNA) specific for a target site in the genome of the cell, and wherein the transposon-encoded CRISPR-Cas system integrates the donor nucleic acid proximal to the target site in the genome of the at least one cell.

In some embodiments, provides herein are methods of treating a cell comprising: a) contacting at least one cell with a composition that comprises: i) an engineered transposon-encoded CRISPR-Cas system, and/or ii) one or more nucleic acid sequence(s) encoding the engineered transposon-encoded CRISPR-Cas system, wherein the transposon-encoded CRISPR-Cas system comprises: i) at least one Cas protein, ii) at least one guide RNA (gRNA) specific for a target site, iii) an engineered transposon system comprising: A) TnsA, B) TnsB, C) TnsC, and D) a TniQ family protein, wherein the TnsA comprises one or more inactivating point mutations, and iv) a donor nucleic acid sequence comprising a cargo nucleic acid sequence and first and second transposon end sequences, wherein the cargo nucleic acid sequence is flanked by the first and second transposon end sequences, and wherein the transposon-encoded CRISPR-Cas system integrates a copy of the donor nucleic acid proximal to a target site in the genome of the at least one cell using a using a copy-and-paste transposition pathway involving replicative transposition.

In some embodiments, provided herein are methods of treating a cell comprising: a) contacting at least one cell with a composition that comprises: i) first and second engineered transposon-encoded CRISPR-Cas systems, and/or ii) one or more nucleic acid sequence(s) encoding the first and second engineered transposon-encoded CRISPR-Cas systems, wherein the first transposon-encoded CRISPR-Cas system comprises: i) at least one Cas protein, ii) a first RNA (gRNA) specific for a first target site, iii) an engineered transposon system, and iv) a first donor nucleic acid sequence comprising a first cargo nucleic acid sequence and first and second transposon end sequences, wherein the first cargo nucleic acid sequence is flanked by the first and second transposon end sequences, and wherein the second transposon-encoded CRISPR-Cas system comprises: i) at least one Cas protein, ii) a second RNA (gRNA) specific for a second target site, iii) an engineered transposon system, and iv) a second donor nucleic acid sequence comprising a second cargo nucleic acid sequence and third and fourth transposon end sequences, wherein the second cargo nucleic acid sequence is flanked by the third and fourth transposon end sequences, and wherein the first transposon-encoded CRISPR-Cas system integrates the first donor nucleic acid proximal to the first target site in the at least one cell, and wherein the second transposon-encoded CRISPR-Cas system integrates the second donor nucleic acid proximal to the second target site in the at least one cell.

In some embodiments, provided herein are methods comprising: a) contacting a sample with: i) an engineered transposon-encoded CRISPR-Cas system, and/or ii) one or more vectors encoding the engineered transposon-encoded CRISPR-Cas system, wherein the sample comprises an input nucleic acid sequence comprising: A) a double stranded nucleic acid sequence of interest (NASI), B) a double stranded first flanking region on one side of the NASI, and C) a double stranded second flanking region on the other side of the NASI, and wherein the transposon-encoded CRISPR-Cas system comprises: i) at least one Cas protein, ii) an engineered transposon system; iii) a first left transposon end sequence; iv) a first right transposon end sequence which is not covalently attached to the first left transposon end sequence; v) a second left transposon end sequence; vi) a second right transposon end sequence which is not covalently attached to the second left transposon end sequence; vii) a first guide RNA (gRNA-1) targeting the first left and first right transposon end sequences to the first flanking region, and viii) a second guide RNA (gRNA-2) targeting the second left and second right transposon end sequences to the second flanking region, and ix) a third guide RNA (gRNA-3), b) incubating the sample under conditions such that: i) the first left transposon end sequence and the first right transposon end sequence are integrated into the first flanking region; ii) the second left transposon end sequence and the second right transposon end sequence are integrated into the second flanking region, thereby generating a transposable sequence comprising the NASI flanked by the first left transposon end sequence and the second right transposon end sequence; and iii) the transposable sequence is cut from its location in the genome by the engineered transposon system and pasted into a different location in the genome guided by the gRNA-3.

In some embodiments, provided herein are methods of treating a cell comprising: a) contacting at least one cell with a composition that comprises: i) first and second engineered transposon-encoded CRISPR-Cas systems, and/or ii) one or more nucleic acid sequence(s) encoding the first and second engineered transposon-encoded CRISPR-Cas systems, wherein the first transposon-encoded CRISPR-Cas system comprises: i) at least one Cas protein, ii) a first RNA (gRNA) specific for a first target site in the genome of the cell, iii) an engineered transposon system, and iv) a first donor nucleic acid sequence comprising a first cargo nucleic acid sequence and first and second transposon end sequences, wherein the first cargo nucleic acid sequence is flanked by the first and second transposon end sequences, and wherein the second transposon-encoded CRISPR-Cas system comprises: i) at least one Cas protein, ii) a second RNA (gRNA) specific for a second target site in the genome of the cell, iii) an engineered transposon system, and iv) a second donor nucleic acid sequence comprising a second cargo nucleic acid sequence and third and fourth transposon end sequences, wherein the second cargo nucleic acid sequence is flanked by the third and fourth transposon end sequences, and b) incubating the cell under conditions such that: i) the first transposon-encoded CRISPR-Cas system integrates the first donor nucleic acid proximal to the first target site in the genome of at least one cell; ii) the second transposon-encoded CRISPR-Cas system integrates the second donor nucleic acid proximal to the second target site in the genome of at least one cell, thereby generating a transposable sequence comprising the first transposon end sequence, the fourth transposon end sequence, and the region of the genome between the first and fourth transposon end sequences; and iii) the transposable sequence is cut from its location in the genome by the engineered transposon system and pasted into a different location in the genome.

In some embodiments, the engineered transposon system comprises: i) TnsA, ii) TnsB, iii) TnsC, and iv) a TniQ family protein. In some embodiments, the at least one guide RNA comprises at least two distinct gRNAs, each of which direct the donor nucleic acid to integrate proximal to a distinct target site. In certain embodiments, the at least one guide RNA comprises at least ten distinct gRNAs, each of which direct the donor nucleic acid to integrate at a distinct target site.

In some embodiments, the first transposon end sequence is a left transposon end sequence, and wherein the second transposon end sequence is a right transposon end sequence. In some embodiments, the left and/or right transposon end sequence is a variant sequence that increase the efficiency of integration of the donor nucleic acid sequence compared to corresponding wild-type left and/or right transposon end sequences. In some embodiments, the left and/or right transposon end sequence alter the orientation bias of the donor nucleic acid sequence when integrated proximal to the target site in the genome as compared to corresponding wild-type left and/or right transposon end sequences. In some embodiments, the orientation bias favors tRL. In some embodiments, the orientation bias favors tLR.

In some embodiments, the first and/or second transposon end sequences code for a functional protein linker sequence. In some embodiments, the genome of the cell comprises a target-protein encoding gene, wherein the cargo nucleic acid sequence encodes an amino acid sequence of interest, and wherein the donor nucleic acid sequence is inserted adjacent to or within the target protein-encoding gene to generate a fusion-protein encoding sequence, wherein the fusion protein comprises the amino acid sequence of interest appended to the target protein. In some embodiments, the amino acid sequence of interest is selected from the group consisting of: a fluorescent protein, an epitope tag, and a degron tag. In some embodiments, the genome of the cell comprises a target-protein encoding gene, wherein the cargo nucleic acid sequence comprises: i) an amino acid sequence of interest encoding region (AASIER), ii) splice acceptor and/or donor sites that flank the AASIER, and wherein the donor nucleic acid sequence is inserted adjacent to or within the target protein-encoding gene to generate a synthetic engineered exon that enables in-frame tagging of the target protein with the amino acid sequence of interest.

In some embodiments, the at least one Cas protein comprises Cas5, Cas6, Cas7, and Cas8. In some embodiments, the Type I CRISPR-cas system is a Type I-F variant. In some embodiments, the Type I-F variant is from a bacteria selected from the group consisting of: *Vibrio cholerae*, *Photobacterium iliopiscarium*, *Pseudoalteromonas* sp. P1-25, *Pseudoalteromonas ruthenica*, *Photobacterium ganghwense*, *Shewanella* sp. UCD-KL21, *Vibrio diazotrophicus*, *Vibrio* sp. 16, *Vibrio* sp. F12, *Vibrio splendidus*, *Aliivibrio wodanis*, and *Parashewanella spongiae*. In certain embodiments, the Type I-F variant is from a bacteria selected from the group consisting of: *Vibrio cholerae* strain 4874, *Photobacterium iliopiscarium* strain NCIMB, *Pseudoalteromonas* sp. P1-25, *Pseudoalteromonas ruthenica* strain S3245, *Photobacterium ganghwense* strain JCM, *Shewanella* sp. UCD-KL21, *Vibrio cholerae* strain OYP7GO4, *Vibrio cholerae* strain M1517, *Vibrio diazotrophicus* strain 60.6 F, *Vibrio* sp. 16, *Vibrio* sp. F12, *Vibrio splendidus* strain UCD-SED10, *Aliivibrio wodanis* 06/09/160, and *Parashewanella spongiae* strain HJ039. In some embodiments, the Type I-F variant if from *Vibrio cholerae* strain HE-45.

In some embodiments, the at least one Cas protein of the CRISPR-cas system is derived from a Type V CRISPR-cas system. In some embodiments, the Type V CRISPR-Cas system is from *Scytonema hofmannii* PCC 7110.

In some embodiments, the transposon-encoded CRISPR-Cas system integrates the donor nucleic acid sequence using a cut-and-paste transposition pathway. In some embodiments, the at least one gRNA contains an extended-length guide sequence that targets an extended-length target site, wherein the extended-length guide sequence is at least 25 nucleotides in length (e.g., 25 . . . 30 . . . 40 . . . 50 or more). In some embodiments, the at least one gRNA comprises an extended-length guide sequence.

In some embodiments, the engineered transposon system comprises: i) TnsA, ii) TnsB, iii) TnsC, and iv) a TniQ family protein. In some embodiments, the TnsA and TnsB are fused into a single TnsA-TnsB fusion polypeptide. In some embodiments, the TniQ is fused to the at least one Cas protein, generating a TniQ-Cas fusion polypeptide.

In some embodiments, the cargo nucleic acid sequence comprises an element selected from the group consisting of: a natural transcription promoter element, a synthetic transcriptional promoter element, an inducible transcriptional promoter element, a constitutive transcription promoter element, a natural transcriptional termination element, a synthetic transcriptional termination element, an origin of replication, a replication termination sequence, a centromeric sequence, and a telomeric sequence. In some embodiments, the cargo nucleic acid sequence encodes at least one of the following: a therapeutic protein, a metabolic pathway, and/or a biosynthetic pathway.

In some embodiments, provided herein are systems for RNA-guided DNA integration, comprising: a vector (or other nuclei acid sequence) comprising from 5' to 3': a) nucleic acid encoding one or more transposon system proteins; b) nucleic acid encoding a guide RNA; and c) nucleic acid encoding a donor nucleic acid comprising first and second transposon ends and a cargo nucleic acid.

In some embodiments, the nucleic acid encoding a guide RNA is in proximity to said first transposon end, such that self-targeting of proximal to said guide RNA is prevented. In some embodiments, the nucleic acid encoding the guide RNA is in proximity to the donor nucleic acid, such that self-targeting of proximal to said guide RNA is prevented.

In some embodiments, the nucleic acid encoding the guide RNA is within 10,000 bases of said first transposon end (e.g., within 10,000 . . . 5000 . . . 2000 . . . 1000 . . . 500, 200 . . . 100 . . . 50 . . . 20 . . . 10 bases of the first transposon end). In some embodiments, the nucleic acid encoding the guide RNA is within 1000 or 500 bases of the first transposon end.

In some embodiments, the transposon system proteins comprise one or more of TnsA, TnsB, TnsC, and TnsD and/or TniQ. In some embodiments, the vector further comprises nucleic acid expressing one or more cas proteins positioned between said nucleic acid encoding one or more transposon system proteins and said nucleic acid encoding a donor. In some embodiments, the one or more Cas protein comprise Cas5, Cas6 Cas7, and Cas8; or c2C5.

In some embodiments, provided herein are methods of reducing self-targeting of an RNA-guided DNA integration system comprising expressing the vector (or other nucleic acid sequence) of the above in cell. In some embodiments, the cell is a cell type whose fitness is impacted by maintenance of vectors.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 1A is an exemplary scenario for Tn6677 transposition into plasmid or genomic target sites complementary to a gRNA. FIG. 1B is exemplary plasmid schematics for transposition experiments in which a transposon is mobilized in trans. The CRISPR array contains two repeats (grey diamonds) and a single spacer (maroon rectangle). FIG. 1C is the genomic locus targeted by gRNA-1 and gRNA-2, two potential transposition products, and the PCR primer pairs to selectively amplify them. FIG. 1D is the PCR analysis of transposition with a non-targeting (nt) gRNA and gRNA-1, resolved by agarose gel electrophoresis. FIG. 1E is PCR analysis of transposition with gRNA-nt, gRNA-1, and gRNA-2 using four distinct primer pairs, resolved by agarose gel electrophoresis. FIG. 1F is Sanger sequencing chromatograms for upstream and downstream junctions of genomically integrated transposons from experiments with gRNA-1 and gRNA-2. Overlapping peaks for gRNA-2 suggest the presence of multiple integration sites. The distance between the 3' end of the protospacer and the first base of the transposon sequence is designated 'd'. TSD, target site duplication. FIG. 1G is next-generation sequencing (NGS) analysis of the distance between the Cascade target site and transposon integration site, determined for gRNA-1 and gRNA-2 with four primer pairs. FIG. 1H is the genomic locus targeted by gRNA-3 and gRNA-4. FIG. 1I is the PCR analysis of transposition with gRNA-nt, gRNA-3, and gRNA-4, resolved by agarose gel electrophoresis.

FIG. 2A is PCR analysis of transposition with gRNA-4 and a panel of gene deletions or point mutations, resolved by agarose gel electrophoresis. FIG. 2B is SDS-PAGE analysis of purified TniQ, Cascade, and a TniQ-Cascade co-complex. * denotes an HptG contaminant. FIG. 2C is denaturing urea-PAGE analysis of co-purifying nucleic acids. FIG. 2D is RNA sequencing analysis of RNA co-purifying with Cascade (top). Reads mapping to the CRISPR array reveal the mature gRNA sequence (SEQ ID NO: 1655, bottom). FIG. 2E is PCR analysis (left) of transposition experiments testing whether generic R-loop formation or artificial TniQ tethering can direct targeted integration. The *V. cholerae* transposon and TnsA-TnsB-TnsC were combined with DNA targeting components comprising either *V. cholerae* Cascade (Vch), *P. aeruginosa* Cascade (Pae), or *S. pyogenes* dCas9-RNA (dCas9). TniQ was either expressed on its own from pTnsABCQ or as a fusion to the targeting complex (pCas-Q) at either the Cas6 C-terminus (6), Cas8 N-terminus (8), or dCas9 N- (N) or C-terminus (C). The schematics (right) show some of the embodiments being test. FIG. 2F is a schematic of the R-loop formed upon target DNA binding by Cascade, with the approximate position of each protein subunit denoted. The putative TniQ binding site and the distance to the primary integration site are indicated.

FIGS. 3A-3K demonstrate the influence of cargo size, PAM sequence, and gRNA mismatches on RNA-guided DNA integration. FIG. 3A is a schematic of alternative integration orientations and the primer pairs to selectively detect them by qPCR. FIG. 3B is qPCR-based quantification of transposition efficiency in both orientations with gRNA-nt, gRNA-3, and gRNA-4. FIG. 3C is total integration efficiency with gRNA-4 as a function of transposon size. The arrow denotes the 'WT' pDonor used in most assays throughout this study. FIG. 3D shows a schematic of gRNAs tiling along the lacZ gene in 1-bp increments relative to gRNA-4 (4.0) (top), and the resulting integration efficiencies determined by qPCR (bottom). Data are normalized to gRNA-4.0, and the 2-nucleotide PAM for each gRNA is shown. FIG. 3E is a heat map showing the integration site distribution (x-axis) for each of the tiled gRNAs (y-axis) in FIG. 3D, determined by NGS. The 49-bp distance for each gRNA is denoted with a black box.

FIG. 3F is a schematic of gRNAs mutations in 4-nt blocks to introduce gRNA-target DNA mismatches (top), and the resulting integration efficiencies determined by qPCR (bottom). Data are normalized to gRNA-4. FIG. 3G is the gRNA-4 spacer length was shortened or lengthened by 12-nt (top), and the resulting integration efficiencies were determined by qPCR (bottom). Data are normalized to gRNA-4. The inset shows a comparison of integration site distributions for gRNA-4 and gRNA-4+12, determined by NGS. FIG. 3H is another example of total integration efficiency with gRNA-4 as a function of transposon cargo size. The stated size includes the cargo and transposon ends, and the arrow denotes the original pDonor. FIG. 3I is a third example of total integration efficiency with gRNA-4 as a function of transposon cargo size. The stated sizes do not include the left and right end sequences. FIG. 3J is a comparison of integration site distributions for gRNA-4 and gRNA-4(mm29-32). FIG. 3K shows results following shortening or lengthening of gRNA-4 spacer lengths by 6-nt increments, and the resulting integration efficiencies as determined by qPCR (left). Data are normalized to gRNA-4. Comparison of integration site distributions for gRNA-4 and gRNA-4 (+12nt) is shown on the right. Data in FIGS. 3B-3D, 3F, and 3G are shown as mean±s.d. for n=3 biologically independent samples.

FIG. 4A is a schematic of the genomic locus targeted by gRNAs 4-8 (top), and PCR analysis of transposition resolved by agarose gel electrophoresis (bottom). FIG. 4B is a schematic of an exemplary Tn-seq workflow for deep sequencing of genome-wide transposition events. FIG. 4C is the mapped Tn-seq reads from transposition experiments with the mariner transposon, and with the *V. cholerae* transposon programmed with either gRNA-nt or gRNA-4. The gRNA-4 target site is denoted with a maroon triangle. FIG. 4D is the Sequence logo of all mariner Tn-seq reads, highlighting the TA dinucleotide target-site preference. FIG. 4E is comparison of integration site distributions for gRNA-4 determined by PCR amplicon sequencing and Tn-seq, for the T-RL product; the distance between the Cascade target site and transposon integration site is shown. FIG. 4F is a zoom-in view of Tn-seq read coverage at the primary integration site for experiments with gRNA-4, highlighting the 5-bp target site duplication (TSD); the distance from the Cascade target site is shown. FIG. 4G is the genome-wide distribution of genome-mapping Tn-seq reads from transposition experiments with gRNAs 9-16 for the *V. cholerae* transposon. The location of each target site is denoted with a maroon triangle.

FIG. 6A is the genomic organization of the native *E. coli* Tn7 transposon adjacent to its known attachment site (attTn7) within the glmS gene. FIG. 6B is schematics of exemplary expression and donor plasmids for Tn7 transposition experiments. FIG. 6C is a schematic of the genomic locus containing the conserved TnsD binding site (attTn7), including the expected and alternative orientation Tn7 transposition products and PCR primer pairs to selectively amplify them. FIG. 6D is the PCR analysis of Tn7 transposition, resolved by agarose gel electrophoresis. Amplification of rssA serves as a loading control. FIG. 6E is the Sanger sequencing chromatograms of both upstream and downstream junctions of genomically integrated Tn7. TSD, target site duplication. FIG. 6F is the genomic organization of the native *V. cholerae* strain HE-45 Tn6677 transposon. Genes that are conserved between Tn6677 and the *E. coli* Tn7 transposon, and between Tn6677 and a canonical I-F CRISPR-Cas system from *Pseudomonas aeruginosa*, are highlighted. The cas1 and cas2-3 genes, which mediate spacer acquisition and DNA degradation during the adaptation and interference stages of adaptive immunity, respectively, are missing from CRISPR-Cas systems encoded by Tn7-like transposons. Similarly, the tnsE gene, which facilitates non-sequence-specific transposition, is absent. The *V. cholerae* HE-45 genome contains another Tn7-like transposon (located within GenBank accession ALED01000025.1), which lacks an encoded CRISPR-Cas system and exhibits low sequence similarity to the Tn6677 transposon investigated in this study.

FIG. 7A shows the genomic locus targeted by gRNA-3 and gRNA-4, including both potential transposition products and the PCR primer pairs to selectively amplify them (top). Next-generation sequencing (NGS) analysis of the distance between the Cascade target site and transposon integration site for gRNA-3 (left) and gRNA-4 (right), determined with two alternative primer pairs. FIG. 7B shows a schematic of the lacZ locus with or without integrated transposon after transposition experiments with gRNA-4 (top); T-LR and T-RL denote transposition products in which the transposon left end and right end are proximal to the target site, respectively. Primer pairs g and h (external-internal) selectively amplify the integrated locus, whereas primer pair i (external-external) amplifies both unintegrated and integrated loci. PCR analysis of 10 colonies after 24-hour growth on +IPTG plates (bottom left) indicates that all colonies contain integration events in both orientations (primer pairs g and h), but with efficiencies sufficiently low that the unintegrated product predominates after amplification with primer pair i. After resuspending cells, allowing for an additional 18-hour clonal growth on—IPTG plates, and performing the same PCR analysis on 10 colonies (bottom right), 3/10 colonies now exhibit clonal integration in the T-LR orientation (compare primer pairs h and i). The remaining colonies show low-level integration in both orientations, which presumably occurred during the additional 18-hour growth due to leaky expression. These analyses indicate that colonies are genetically heterogeneous after growth on +IPTG plates, and that RNA-guided DNA integration only occurs in a proportion of cells within growing colonies. I, integrated product; U, unintegrated product; *, mispriming product also present in the negative (unintegrated) control. FIG. 7C is a photograph of LB-agar plate used for blue-white colony screening. Cells from IPTG-containing plates were re-plated on X-gal containing plates, and white colonies expected to harbor lacZ-inactivating transposon insertions were selected for further characterization. FIG. 7D is PCR analysis of *E. coli* strains identified by blue-white colony screening that harbor clonally integrated transposons, shown as in FIG. 7B. FIG. 7E is a schematic of Sanger sequencing coverage across the lacZ locus for strains shown in FIG. 7D. FIG. 7F is the PCR analysis of transposition experiment with gRNA-4 after serially diluting lysate from a clonally integrated strain with lysate from a control strain to simulate variable integration efficiencies, shown as in FIG. 7B. Transposition products can be reliably detected by PCR with an external-internal primer pair at efficiencies above 0.5%, but PCR bias leads to preferential amplification of the unintegrated product using the external-external primer pair at any efficiency substantially below 100%. FIG. 7G is a schematic of the lacZ locus with or without integrated Tn7 (top), and further colony PCR analysis of Tn7 transposition experiment with gRNA4 using primer pair a (middle) or primer pair b (bottom), resolved by agarose gel electrophoresis and in FIG. 7B.

FIG. 8A-8E are the analysis of *V. cholerae* Cascade and TniQ-Cascade complexes. FIG. 8A is schematics of exemplary expression vectors for recombinant protein or ribonucleoprotein complex purification. FIG. 8B shows the SDS-PAGE analysis of purified TniQ, Cascade, and TniQ-Cascade complexes (left), highlighting protein bands excised for in-gel trypsin digestion and mass spectrometry analysis. The table (right) lists *E. coli* and recombinant proteins identified from these data, and spectral counts of their associated peptides. Note that Cascade and TniQ-Cascade samples used for this analysis are distinct from the samples presented in FIG. 2. FIG. 8C is the size exclusion chromatogram of the TniQ-Cascade co-complex on a Superose 6 10/300 column (left), and a calibration curve generated using protein standards (right). The measured retention time of TniQ-Cascade (maroon) is consistent with a complex having a molecular weight of ~440 kDa. FIG. 8D is the RNase A and DNase I sensitivity of nucleic acids that co-purified with Cascade and TniQ-Cascade, resolved by denaturing urea-PAGE. FIG. 8E is the results from the TniQ, Cascade, and a Cascade +TniQ binding reactions resolved by size exclusion chromatography (left); indicated fractions were analyzed by SDS-PAGE (right). * denotes an HptG contaminant.

FIGS. 9A-9C are control experiments demonstrating efficient DNA targeting with Cas9 and *P. aeruginosa* Cascade. FIG. 9A is a schematic of the exemplary plasmid expression systems for *S. pyogenes* Cas9-sgRNA (Type II-A, left) and *P. aeruginosa* Cascade (PaeCascade) and Cas2-3 (Type I-F, right). The Cas2-3 expression plasmid was omitted from experiments described in FIG. 2E. FIG. 9B are graphs of the results from cell killing experiments using *S. pyogenes* Cas9-sgRNA (left) or PaeCascade and Cas2-3 (right), monitored by determining colony forming units (CFU) upon plasmid transformation. Complexes were programmed with gRNAs targeting the same genomic lacZ sites as with *V. cholerae* gRNA-3 and gRNA-4, such that efficient DNA targeting and degradation results in lethality and thus a drop in transformation efficiency. FIG. 9C is a graph of the results of qPCR-based quantification of transposition efficiency from experiments using the *V. cholerae* transposon donor and TnsA-TnsB-TnsC, together with DNA targeting components comprising either *V. cholerae* Cascade (Vch), *P. aeruginosa* Cascade (Pae), or *S. pyogenes* dCas9-RNA. TniQ was either expressed on its own from pTnsABCQ or as a fusion to the targeting complex (pCas-Q) at either the Cas6 C-terminus (6), Cas8 N-terminus (8), or dCas9 N- (N) or C-terminus (C). The exact same sample lysates as in FIG. 2E were used. Data in FIGS. 9B and 9C are shown as mean±s.d. for n=3 biologically independent samples.

FIG. 10A is a schematic of the potential lacZ transposition products in either orientation for both gRNA-3 and gRNA-4, and qPCR primer pairs to selectively amplify them. T-LR and T-RL denote transposition products in which the transposon left end and right end are proximal to the target site, respectively. FIG. 10B includes graphs of the comparison of simulated integration efficiencies for T-LR and T-RL orientations, generated by mixing clonally integrated and unintegrated lysates in known ratios, versus experimentally determined integration efficiencies measured by qPCR. FIG. 10C is a graph of the comparison of simulated mixtures of bidirectional integration efficiencies for gRNA-4, generated by mixing clonally integrated and unintegrated lysates in known ratios, versus experimentally determined integration efficiencies measured by qPCR. FIG. 10D is a graph of the RNA-guided DNA integration efficiency as a function of IPTG concentration for gRNA-3 and gRNA-4, measured by qPCR. FIG. 10E is a graph of the bidirectional integration efficiencies measured by qPCR for simulated mixtures of bidirectional integration efficiencies for gRNA4, generated by mixing clonally integrated and unintegrated lysates in known ratios. Data in FIGS. 10B-10C are shown as mean±s.d. for n=3 biologically independent samples.

FIGS. 11A-11D show the influence of transposon end sequences on RNA-guided DNA integration. FIG. 11A shows the sequence (top) and schematic (bottom) of *V. cholerae* Tn6677 left and right end sequences. The putative TnsB binding sites (blue) were determined based on sequence similarity to the TnsB binding sites. The 8-bp terminal ends are shown in yellow, and the empirically determined minimum end sequences required for transposition are denoted with red dashed boxes. FIG. 11B are graphs of the integration efficiency with gRNA-4 as a function of transposon end length, as determined by qPCR. FIG. 11C is a graph of the relative fraction of both integration orientations as a function of transposon end length, determined by qPCR. ND, not determined. FIG. 11D is a graph of the integration efficiency with gRNA-4 as a function of transposon end truncations (bottom), determined by qPCR for both orientations independently. The empirically determined, minimum end sequences required are shown as dashed boxes. Data in FIGS. 11B and 11C are shown as mean±s.d. for n=3 biologically independent samples.

FIGS. 12A-12D are the analysis of RNA-guided DNA integration for PAM-tiled gRNAs and extended spacer length gRNAs. FIG. 12A is graphs of the integration site distribution for all gRNAs described in FIGS. 3D-3E having a normalized transposition efficiency >20%, determined by NGS. FIG. 12B is a graph of the integration site distribution for a gRNA containing mismatches at positions 29-32, compared to the distribution with gRNA-4, determined by NGS. FIG. 12C shows the resulting integration efficiencies, determined by qPCR, following shortening or lengthening of the gRNA-4 spacer length by 6-nt increments. Data are normalized to gRNA-4 and are shown as mean±s.d. for n=3 biologically independent samples. FIG. 12D is graphs of the integration site distribution for extended length gRNAs compared to the distribution with gRNA-4, determined by NGS.

FIGS. 13A-13H show the development and analysis of transposon-insertion sequencing (Tn-seq). FIG. 13A is a schematic of the *V. cholerae* transposon end sequences. The 8-bp terminal sequence of the transposon is boxed and highlighted in light yellow. Mutations generated to introduce MmeI recognition sites are shown in red, and the resulting recognition site is highlighted in red. Cleavage by MmeI occurs 17-19 bp away from the transposon end, generating a 2-bp overhang. FIG. 13B is a graph of the comparison of integration efficiencies for the wild-type and MmeI-containing transposon donors, determined by qPCR. Labels on the x-axis denote which plasmid was transformed last; higher integration efficiencies were reproducibly observed when pQCascade was transformed last (gRNA-4) than when pDonor was transformed last. The transposon containing an MmeI site in the transposon 'right' end (R*-L pDonor) was used for all Tn-seq experiments. Data are shown as mean±s.d. for n=3 biologically independent samples. FIG. 13C is a schematic of the plasmid expression system for Himar1C9 and the mariner transposon. FIG. 13D is a scatter plot showing correlation between two biological replicates of Tn-seq experiments with the mariner transposon. Reads were binned by *E. coli* gene annotations, and a linear regression fit and Pearson linear correlation coefficient (r) are shown. FIG. 13E is a schematic of 100-bp binning approach used for Tn-seq analysis of transposition experiments with the *V. cholerae* transposon, in which bin-1 is defined as the first 100-bp immediately downstream (PAM-distal) of the Cascade target site. FIG. 13F is scatter plots showing correlation between biological replicates of Tn-seq experiments with the *V. cholerae* transposon programmed with gRNA-4. All highly sampled reads fall within bin-1; low-level but reproducible, long-range integration into 100-bp bins just upstream and downstream of the primary integration site (bins −1, 2, and 3) were also observed. FIG. 13G is a scatter plot showing correlation between biological replicates of Tn-seq experiments with the *V. cholerae* transposon programmed with gRNA-nt. FIG. 13H is a scatter plot showing correlation between biological replicates of Tn-seq experiments with the *V. cholerae* transposon expressing TnsA-TnsB-TnsC-TniQ but not Cascade. For FIGS. 13F-13H, bins are only plotted when they contain at least one read in either data set.

FIGS. 14A and 14B are genome-wide distribution of genome-mapping Tn-seq reads from transposition experiments with the *V. cholerae* transposon programmed with gRNAs 1-8 (FIG. 14A) and gRNAs 17-24 (FIG. 14B). The location of each target site is denoted with a maroon triangle.
† The lacZ target site for gRNA-3 was found to be duplicated within the λ DE3 prophage, as is the transposon integration site; Tn-seq reads for this dataset were mapped to both genomic loci for visualization purposes only, though the locus they derive from was unable to be determined.
FIGS. 14C-14E are graphs of the analysis of integration site distributions for gRNAs 1-24 determined from the Tn-seq data; the distance between the Cascade target site and transposon integration site is shown. Data for both integration orientations are superimposed, with filled blue bars representing the T-RL orientation and the dark outlines representing the T-LR orientation. Values in the top-right corner of each graph give the on-target specificity (%), calculated as the percentage of reads resulting from integration within 100-bp of the primary integration site to the total number of reads aligning to the genome, and the orientation bias (X:Y), calculated as the ratio of reads for the T-RL orientation to reads for the T-LR orientation. The majority of gRNAs favor integration in the T-RL orientation 49-50 bp downstream of the Cascade target site. gRNA-21 is grayed out because the expected primary integration site is present in a repetitive stretch of DNA that does not allow us to map the reads confidently. * indicates samples for which more than 1% of the genome-mapping reads could not be uniquely mapped are marked.

FIG. 16A is a schematic of cut-and-paste transposition. The *E. coli* Tn7 transposon mobilizes via a cut-and-paste mechanism. TnsA and TnsB cleave both strands of the transposon DNA at both ends, leading to clean excision of a linear dsDNA, which contains short 3-nucleotide 5'-overhangs on both ends (not shown). The free 3'-OH ends are then used as a nucleophile by TnsB to attack phosphodiester bonds on both strands of the target DNA, resulting in concerted transesterification reactions. After gap fill-in, the transposition reaction is complete, and the integrated transposon is flanked by 5-bp target site duplications (TSD) on both ends as a result of the gap fill-in reaction. FIG. 16 is a schematic of copy-and-paste (replicative) transposition. Some transposons instead mobilize via a copy-and-paste pathway, also known as replicative transposition. This results when the 5' ends of the transposon donor DNA are not broken during the excision step, as is the case when the tnsA endonuclease gene is absent from the gene operon encoding the transposition proteins. In this case, the 3'-OH ends are still liberated and can participate in staggered transesterification reactions with the target DNA (inset, middle right), catalyzed by TnsB, but the 5' ends of the transposon remain covalently linked to the remainder of the DNA within the donor DNA molecule, which can be a genome or a plasmid vector. This copy-and-paste reaction results in what's known as a Shapiro intermediate (middle), in which the entirety of the donor DNA, including the transposon sequence itself, as well as the flanking sequences, is joined together with the broken target DNA. This intermediate can only be resolved during subsequent DNA replication (bottom left), which results in a so-called cointegrate product. This cointegrate harbors two copies of the transposon itself (orange rectangle), flanked by the TSD on one side. Importantly, the cointegrate also harbors the entirety of the donor DNA molecule, as well as the entirety of the target DNA molecule. Thus, in cases where the transposon is encoded on a plasmid vector, the entirety of the vector is joined to the target DNA during replicative transposition. At some frequency, the cointegrate product can be resolved into the products shown at the right, either through the action of a dedicated resolvase protein (e.g., the TniR protein in Tn5090/Tn5053), or through endogenous homologous recombination because of extensive homology between the two copies of the transposon itself in the cointegrate product. Cointegrate resolution results in a target DNA harboring a single transposon flanked by the TSD, as well as a regenerated version of the donor DNA molecule.

FIG. 17A is a schematic of Tn7 and Tn7-like transposons that have been described in the literature. (Panel reproduced from FIG. 9.1*b* and adapted from Peters et al., *Mol Microbiol* 93, 1084-1092 (2014).) FIG. 17B a schematic of a representative Tn7-like transposon that harbors a Type I-F variant CRISPR-Cas systems, whose genes encode a Cascade complex; the Tn6677 transposon from *Vibrio cholerae* that mediates RNA-guided DNA insertion is a member of this family. Note the similarities in the transposition genes found in Tn6677 and related transposons and Tn7: the tnsA-tnsB-tnsC operon is maintained, whereas the tnsD homolog known as tniQ is encoded within the operon that encodes the Cas8-Cas7-Cas6 proteins that collectively form the RNA-guided TniQ-Cascade complex. The TnsA and TnsB protein products mediate transposon excision, whereas TnsB mediates integration of the transposon into the target DNA. FIG. 17C is a schematic of a representative Tn7-like transposon that harbors a Type V CRISPR-Cas system, whose gene encodes Cas12k (also known as C2c5). Whereas tnsB, tnsC, and tniQ genes are present in these transposons, the tnsA gene is absent, indicating that these transposons do not encode the necessary machinery to mediate cut-and-paste transposition. Instead, they are likely to proceed via copy-and-paste replicative transposition, resulting in a cointegrate product rather than a clean integration product.

FIG. 20A shows one embodiment where HEK293T cells are transfected with vectors that encode the respective protein and RNA machinery to recapitulate RNA-guided DNA integration. FIG. 20B shows another embodiment in which 5'-capped (red circle) and 3'-polyadenylated mRNAs are synthesized, alongside precursor gRNAs (shown) or fully processed mature gRNAs (not shown), and HEK293T cells are then transfected with a mixture of mRNAs and gRNA. FIG. 20C shows another embodiment in which all the necessary protein and RNA components are purified recombinantly, and HEK293T cells are then transfected with purified protein and ribonucleoprotein components. The above strategies are combined with delivery of the donor DNA (e.g. as on pDonor).

FIG. 21A is a schematic of one embodiment in which HEK293T cells are co-transfected with CRISPR-Tn7 expression vectors alongside both pDonor and pTarget. pDonor contains the mini-transposon construct, harboring Tn7 transposon ends ("L" and "R") flanking a genetic cargo of interest; pTarget harbors the target site (maroon) that is complementary to the gRNA spacer. Successful RNA-guided DNA integration involves excision of the transposon from pDonor (mediated by TnsA and TnsB), followed by RNA-guided integration of the transposon into pTarget, at a fixed distance from the target site. pDonor and pTarget may contain fluorescent reporter genes and/or drug resistance markers to enable selection of cells that undergo an integration event. FIG. 21B is a schematic of another embodiment in which the transposon is again encoded on pDonor, but a gRNA is designed to direct RNA-guided DNA integration to a site within the human genome (schematized with the red chromosome). This results in genomic integration of the transposon a fixed distance from the target site (maroon). Sequences for the plasmids represent only one possible design of the respective plasmids. pTarget Int refers to the integration product after RNA—guided DNA integration into pTarget. The integrated transposon may be detected and further analyzed by PCR, qPCR, and/or next-generation sequencing.

FIG. 22A is a schematic of one embodiment, termed a promoter capture approach, in which HEK293T cells are co-transfected with CRISPR-Tn7 expression vectors alongside pDonor, which contains the mini-transposon construct, harboring Tn7 transposon ends ("L" and "R") flanking a genetic cargo that includes a puromycin resistance gene (puroR) connected to an EGFP gene via a 2A peptide. The genetic cargo does not contain a promoter element and so is not expressed, unless RNA-guided DNA integration places the cargo downstream of a eukaryotic promoter element. The targeted promoter may be in a plasmid (e.g. pTarget) or the genome. Once integrated, the reporter gene is turned on, and integration may be detected via flow cytometry and/or drug selection. pA refers to a poly-adenylation signal, and the promoter (black arrow) may be a CMV promoter or other constitutive or inducible promoter. FIG. 22B is a schematic in which the target site is selected so that integration also disrupts another fluorescent reporter gene encoding mCherry. In this experimental set-up, RNA-guided DNA integration leads to both an increase in GFP signal and a loss of mCherry signal. FIG. 22C is a schematic showing another embodiment in which the reporter in pDonor also contains a promoter element within the genetic cargo, such that the pDonor plasmid itself expresses EGFP and the puromycin resistance gene. In this scenario, integration of the genetic cargo into the genome, or a pTarget plasmid, will lead to expression, regardless of whether a promoter element is present adjacent to the integration site.

FIG. 23A is a schematic of the previously described pQCascade plasmid (pSL0828, encoding gRNA-4) comprising two separate T7 promoters, one of which drives expression of the CRISPR RNA and a second one of which drives expression of the TniQ-Cas8-Cas7-Cas6 operon. FIG. 23B is a schematic of the engineered pQCascade-B and pQCascade-C contain only a single T7 promoter, which drives expression of both the CRISPR RNA and the TniQ-Cas8-Cas7-Cas6 operon. The CRISPR array is placed at either the 5' or 3' end of the transcript. FIG. 23 C is a schematic of the RNA-guided DNA integration experiments utilize pDonor (pSL0527), which contains the genetic cargo flanked by the Tn7 transposon ends, and pTnsABC, which encodes the TnsA-TnsB-TnsC operon. FIG. 23D is the results of the RNA-guided DNA integration experiments performed in E. coli BL21 (DE3) cells and quantified by qPCR. The total integration efficiency is plotted for experiments utilizing pDonor (pSL0527), pTnsABC (pSL0283), and either pQCascade-B (pSL1016) or pQCascade-C (pSL1018).

FIG. 24A is a schematic of pTQC-A (pSL1020) which encodes the CRISPR array and TniQ-Cas8-Cas7-Cas6-TnsA-TnsA-TnsB operon from two T7 promoters. FIG. 24B is a schematic of pTQC-B (pSL1022) encoding the CRISPR array and TniQ-Cas8-Cas7-Cas6-TnsA-TnsA-TnsB operon from a single T7 promoter. FIG. 24C is a schematic of pTQC-C (pSL1024) encoding the TnsA-TnsB-TnsC operon and TniQ-Cas8-Cas7-Cas6-CRISPR operon from two T7 promoters. FIG. 24D is a schematic of pTQC-D (pSL1026) encoding the TnsA-TnsB- TnsC-TniQ-Cas8/Cas5 fusion protein-Cas7-Cas6-CRISPR operon from a single T7 promoter. FIG. 24E is a schematic of the fusion mRNA and CRISPR RNA transcripts encoded by pTQC-B (left) and pTQC-D (right); enzymatic CRISPR RNA processing by Cas6 liberates the mature gRNA without disturbing the remaining mRNA transcript which encodes all the protein components. FIG. 24F shows the results of RNA-guided DNA integration experiments were performed in E. coli BL21(DE3) cells and quantified by qPCR. The total integration efficiency is plotted for experiments utilizing pDonor (pSL0527) and either pTQC-A, pTQC-B, pTQC-C, or pTQC-D, as shown.

FIG. 25A is a schematic of pAIO-A (pSL1120) encoding the CRISPR array and TniQ-Cas8-Cas7-Cas6-TnsA-TnsA-TnsB operon from a single T7 promoter, and also having a downstream mini-transposon donor DNA, comprising the Tn7 transposon ends ("L" and "R") flanking a cargo of interest. FIG. 25B is a schematic of pAIO-A (pSL1120) encoding the CRISPR array and TniQ-Cas8-Cas7-Cas6-TnsA-TnsA-TnsB operon from a single T7 promoter. This entire expression cassette is cloned within the mini-transposon donor DNA, comprising the Tn7 transposon ends ("L" and "R"). RNA-guided DNA integration with this construct results in the genetic components encoding the CRISPR- and Tn7-associated machinery mobilizing within the donor DNA itself.

FIG. 26A shows pAIO-A (pSL1120), further modified to carry one of four constitutive E. coli promoters (top), and introduction of the entire expression cassette into four distinct vector backbones (left). The resulting four-by-four matrix is tested for RNA-guided DNA integration activity in E. coli BL21(DE3) cells and analyzed by PCR, qPCR, and/or next-generation sequencing. These experiments reveal the optimal expression level for a given copy number of the expression plasmid. FIG. 26B is a schematic of pAIO-A (pSL1120) modified to include genetic cargos ranging in size from 0.17 kilobase pair (kbp) to 10 kbp. The resulting plasmids are tested for RNA-guided DNA integration activity in E. coli BL21(DE3) cells and analyzed by PCR, qPCR, and/or next-generation sequencing. These experiments reveal the dependence of cargo size on different expression constructs and designs.

FIG. 30A is schematics of the general plasmid expression system for Tn7-C2c5 transposition experiments. The CRISPR array contains two repeat sequences (grey diamonds) and a single spacer sequence (maroon rectangle). The mini-transposon on pDonor is mobilized by transposases expressed in trans. FIG. 30B is a schematic of the lacZ genomic locus targeted by synthetic gRNAs, including two potential Tn7 transposition products and the PCR primer pairs to selective amplify them.

FIG. 31A is a schematic of the genomic sites within lacZ targeted by six distinct gRNAs; the different PAM sequences (yellow) are denoted, and the target sites are in maroon. FIG. 31B is the PCR-based detection of integration events, resolved by agarose gel electrophoresis. A single upstream primer specific to the 3' end of the lacZ gene was used in combination with a primer reading through the left transposon end (as schematized in FIG. 30B, primer pair c2). Reactions for both the 1:10 and 1:100 diluted lysates are shown as well as a positive control (+C) run on a lysate targeting the same region with the Tn7 transposon from V. cholerae. Potential integration events are detected for the PAM sequences shown in gRNAs 4, 5 and 6.

FIG. 32A is a schematic outlining PCR processes for DNA enrichment. PCR amplicons are generated to enrich the DNA targets of interest, either in a uniplex format, in a multiplex format with multiple primer pairs, or with custom emulsion-based technologies such as Rainstorm. FIG. 32B shows a schematic of molecular inversion probes (MIP) annealing to the input DNA flanking the region of interest for enrichment, leading to gap-fill in and probe circularization by ligation. FIG. 32C is a schematic of the most widely used approach for targeted DNA enrichment, a pool of oligonucleotide-based probes are used to hybridize to sequences of interest, either in an array format (solid support) or in solution, followed by washing and elution steps. The figure is reproduced from: Mamanova et al., *Nat Meth* 7, 111-118 (2010), incorporated herein by reference.

FIGS. 33A-33D are schematics of targeted DNA enrichment using RNA-guided DNA integration with CRISPRTn7. In FIG. 33A, the input DNA, which may be purified genomic DNA, contains a sequence of interest whose enrichment is desired (blue). gRNAs are designed against target sites (target-1 and target-2) that flank the sequence of interest; the target sites themselves are abutted by a protospacer adjacent motif, or PAM, which in one embodiment for the V. cholerae CRISPR-Tn7 sequence is 5'-CC-3'. Purified TniQ-Cascade complexes bearing gRNA-1 and gRNA-2 bind both target sites, leading to recruitment of TnsC and subsequent recruitment of a paired-end complex (PEC) that comprises TnsA, TnsB, and the transposon ends (L and R). Successful recruitment leads to RNA-guided integration of the transposon end sequences a fixed distance downstream of the target sites complementary to both gRNAs. Integration both fragments the input DNA at the integration sites, while also appending transposon end sequences, and in one embodiment, adaptor sequences, that may be used for downstream PCR amplification and/or NGS library preparation and next-generation sequencing (NGS). The stoichiometry of TnsA and TnsB in the paired-end complex is not known, nor is the stoichiometry of TnsC. The transposon L and R ends are denoted by light purple and light orange, respectively; optional adaptor sequences are shown with dark purple and dark orange. The sequence of interest may be selectively amplified, e.g. enriched, in subsequent PCR steps by designing primers against either the transposon end sequences, the adaptor sequences, or both. Sample-specific indices may also be added in this subsequent PCR amplification step. FIG. 33B is a schematic of the possible derivatives of the transposon end sequences are shown. In one embodiment, the paired-end complex comprises two unique transposon ends (purple and orange), which leads to integration of unique sequences on the Watson and Crick strands of the input DNA, for downstream PCR amplification. In other embodiments, the transposon ends are further engineered, so that modified Left (L*) or modified Right (R*) ends are recognized and faithfully integrated by TnsB during RNA-guided DNA integration, leading to uniform integration of the same transposon end sequences, and thus, allowing for downstream PCR amplification using a single primer that recognizes both ends. In further embodiments, the transposon ends are engineered or modified such that one end remains 'dark' in subsequent PCR amplification steps, such that orientation-specific integration of the L and R ends allow for targeted amplification of only certain DNA sequences of interest for targeted DNA enrichment. The 'dark' ends may also simply be R and L ends that are functionally excluded during the PCR amplification step. The bottom row represents transposon end sequences that do not have appended adaptor sequences (dark purple, dark orange). FIG. 33C shows the possible target site and integration site geometries, which differ in the relative positioning of the target sites relative to the DNA sequence of interest, leading to alternative outcomes in what is retained during subsequent steps (e.g. PCR amplification of the integrated transposon ends). In embodiment 1, target-2 is retained; in embodiment 2, both target-1 and target-2 are retained; in embodiment 3, target-1 is retained; in embodiment 4, neither target is retained. In embodiment 5, the targets are selected to reside within the DNA sequence of interest, in a PAM-in configuration, such that RNA-guided DNA integration of the transposon ends occurs just outside the sequence of interest. Further embodiments combine such a strategy on one end, with a target lying outside the sequence of interest on the other side. FIG. 33D is a schematic of the library of gRNAs employed to direct highly multiplexed RNA-guided DNA integration within the input DNA, allowing for subsequent targeted enrichment of many DNA sequences of interest.

FIG. 34A is a schematic of A conventional approach involving mechanical (e.g. sonication) or enzymatic (e.g. dsDNA fragmentase, NEB) fragmentation of the input DNA, which may be purified genomic DNA. Then, after end polishing and A-tailing, sequencing adaptors are appended to all dsDNA ends, and PCR amplification using primers complementary to the universal adaptors leads to DNA libraries spanning the entirety of the input DNA, which may be sequenced in later steps using massively parallel DNA sequencing, such as NGS with the Illumina platform. FIG. 34B is a schematic of tagmentation with engineered Tn5 transposases (e.g. as with the Nextera kit) combining DNA fragmentation and adaptor insertion in a single and rapid step, allowing for considerable savings in time, cost, and labor. The transposon ends, or transposase adaptors, are directly primed in subsequent PCR amplification, prior to NGS. The figure is taken from: Adey et al., Genome Biol 11, R119 (2010).

FIG. 35A is schematics of exemplary expression plasmids cloned to recombinantly express and purify each individual protein component of the V. cholerae CRISPR-Tn7 machinery. Each plasmid encodes an N-terminal decahistidine tag, MBP solubilization tag, and TEV protease recognition sequence upstream of the protein of interest. FIG. 35B is a schematic of gRNA generation either through in vitro transcription from a dsDNA (shown, top) or partially ssDNA/dsDNA (not shown) template, through transcription of a longer transcript that contains self-cleaving ribozymes (middle), or through chemical synthesis (bottom). Libraries of gRNAs are generated by designing libraries of DNA templates or chemically synthesizing libraries of gRNAs. FIG. 35C shows other embodiments, in which TniQ-Cascade is purified recombinantly as a complex comprising TniQ, Cas8, Cas7, Cas6, and gRNA, using the expression plasmids shown. The pCRISPR plasmid noted (pSL0915) encodes gRNA-3 targeting lacZ, but this may be substituted with other plasmids encoding different gRNAs. In another embodiment, TniQ-Cascade is purified from a heterogeneous pool of cells expressing a library of distinct gRNAs (right). FIG. 35D shows other embodiments, in which TnsA and TnsB are purified as a heterodimer using the expression plasmid shown (left), or TnsA, TnsB, and TnsC are all purified as a co-complex using the expression plasmids shown (right). FIG. 35E are schematics of polycistronic expression plasmids.

FIG. 39A is a schematic of one embodiment, in which a three-plasmid approach is used to express the RNA-guided DNA integration (INTEGRATE) components. FIG. 39B is a schematic of another embodiment, in which an all-in-one single plasmid is used for streamlined expression and delivery of the RNA-guided DNA integration (INTEGRATE) components. A simplified schematic is also shown (top).

FIG. 43A is the genetic architecture of the Tn6677 transposon (top), and plasmid constructs used to express and purify the TniQ-Cascade co-complex. Selected cryo-EM reference-free 2D classes in multiple orientations are shown on the right. FIG. 43B is orthogonal views of the cryo-EM map for the TniQ-Cascade complex, showing Cas8 (pink), six Cas7 monomers (green), Cas6 (salmon), crRNA (grey), and TniQ monomers (blue, yellow). The complex adopts a helical architecture with protuberances at both ends. FIG. 43C is a flexible domain in Cas8 comprising residues 277-385 (grey) could only be visualized in low-pass filtered maps. The unsharpened map is shown as semi-transparent, grey map overlaid on the post-processed map segmented and colored according to FIG. 43A. FIG. 43D is a refined model for the TniQ Cascade complex derived from the cryo-EM maps shown in FIG. 43B.

FIG. 44A, left, is the overall view of the TniQ-Cascade cryo-EM unsharpened map (grey) overlaid on the post-processed map segmented and colored as in FIG. 43. FIG. 44A, right, is the cryo-EM map (top) and the refined model (bottom) of the TniQ dimer. The two monomers interact with each other in a head-to-tail configuration and are anchored to Cascade via Cas6 and Cas7.1. FIG. 44B is the secondary structure diagram of the TniQ dimer: eleven α-helices are organized into an N-terminal Helix-Turn-Helix (HTH) domain and a C-terminal TniQ-domain. Dimer interactions between H3 and H11 are indicated, as are interaction sites with Cas6 and Cas7.1. FIG. 44C is the cryo-EM density for the H3-H11 interaction shows clear side-chain features (top), allowing accurate modelling of the interaction (bottom). FIG. 44D is a schematic of the dimer interaction, showing the important dimerization interface between the HTH and TniQ-domain.

FIG. 45A is the top, zoomed area showing the interaction site of Cascade and the TniQ dimer. Cas6 and Cas7.1 are displayed as molecular Van der Waals surfaces, the crRNA is shown as grey spheres, and the TniQ monomers as ribbons. FIG. 45B is the loop connecting TniQ.1 α-helices H6 and H7 (blue) binds within a hydrophobic cavity of Cas6. FIG. 45C shows that Cas7.1 interacts via with the HTH domain of the TniQ.2 monomer (yellow), mainly through H2 and the loop connecting H2 and H3. FIGS. 45D-45E are the experimental cryo-EM densities observed for the TniQ-Cas6 (FIG. 45D) and TniQ-Cas7.1 (FIG. 45E) interaction.

FIG. 46A is a schematic of crRNA and the portion of the dsDNA substrate that was experimentally observed within the electron density map for DNA-bound TniQ-Cascade. Target Strand (TS), non-target strand (NTS), as well as the PAM and seed regions are indicated. FIG. 46B is selected cryo-EM reference-free 2D classes for DNA-bound TniQ-Cascade; density corresponding to dsDNA could be directly observed protruding from the Cas8 component in the 2D averages (white arrows). FIG. 46C is a cryo-EM map for DNA-bound TniQ-Cascade. The crRNA is in dark grey and the DNA is in red. On the right and bottom, detailed views for the PAM and seed recognition regions of the map, with refined models represented as sticks within the electron density. Cas8 is shown in pink, Cas7 in green, crRNA in grey, and DNA in red. FIG. 46D is the *V. cholerae* transposon encodes a TniQ-Cascade co-complex that utilizes the sequence content of the crRNA to bind complementary DNA target sites (left). The incomplete R-loop observed in the structure (middle) may represent an intermediate state that may precede a downstream 'locking' step involving proofreading of the RNA-DNA complementarity. TniQ is positioned at the PAM-distal end of the DNA-bound Cascade complex, where it likely interacts with TnsC during downstream steps of RNA-guided DNA insertion.

FIG. 47A is a representative negatively stained micrograph for 500 nM TniQ-Cascade. FIG. 47B, left, is a representative cryo-EM image for 2 µM TniQ-Cascade. A small dataset of 200 images was collected in a Tecnai F20 microscope equipped with a Gatan K2 camera. FIG. 47B, right, is a reference-free 2D class averages for this initial cryo-EM dataset. FIG. 47C, left, is a representative image from a large dataset collected in a Tecnai Polara microscope equipped with a Gatan K3 detector. FIG. 47C, middle, is detailed 2D class averages were obtained that were used for initial model generation using the SGD algorithm implemented in Relion3 (FIG. 47C, right). FIG. 47D is the image processing workflow used to identify the two main classes of the TniQ cascade complex in open and closed conformations. Local refinements with soft masks were used to improve the quality of the map within the terminal protuberances of the complex. These maps were instrumental for de novo modelling and initial model refinement.

FIG. 48A is a gold standard FSC curve using half maps; the global resolution estimation is 3.4 Å by the FSC 0.143 criterion. FIG. 48B is a cross-validation model-vs-map FSC. Blue curve, FSC between the shacked model refined against half map 1; red curve, FSC against half map 2, not included in the refinement; black curve, FSC between final model against the final map. The overlap observed between the blue and red curves guarantees a non-overfitted model. FIG. 47C is an unsharpened map colored according to local resolutions, as reported by RESMAP. FIG. 48D is a final model colored according to B-factors calculated by REFMAC. FIG. 48E is a flexible Cas8 domain encompassing residues 277-385 contacts the TniQ dimer at the other side of the crescent shape. Applying a Gaussian filter of increasing width to the unsharpened map allows for a better visualization of this flexible region.

FIG. 50A is a final refined model of TniQ-Cascade, with Cas8 in purple, Cas7 monomers in green, Cas6 in red, the TniQ monomers in blue and yellow, and the crRNA in grey. FIG. 50B-50H are final refined models inserted in the final cryo-EM density for select regions of all the molecular components of the TniQ-Cascade complex. Residues are numbered.

FIG. 52A shows TniQ-Cascade residues that interact with the crRNA are indicated. Approximate location for all protein components of the complex are also shown, as well as the position of each Cas7 'finger. ' FIG. 52B shows TniQ-Cascade residues that interact with crRNA and target DNA, shown as in FIG. 52A.

FIG. 53A is a gold-standard FSC curve using half maps; the global resolution estimation is 3.5 Å by the FSC 0.143 criterion. FIG. 53B is a cross-validation model-vs-map FSC. Blue curve, FSC between shacked model refined against half map 1; red curve, FSC against half map 2, not included in the refinement; black curve, FSC between final model against the final map. The overlapping between the blue and red curves guarantees a non-overfitted model. FIG. 53C is an unsharpened map colored according to local resolutions, as reported by RESMAP. Right, slice through the map shown on the left. FIG. 53D shows that local refinements with soft masks improved the maps in flexible regions. Shown the region of the map corresponding to the TniQ dimer. Unsharpened maps colored according to the local resolution estimations are shown before (left) and after (right) masked refinements. FIG. 53E is the final model for the TniQ dimer region, colored according to the local B-factors calculated by REFMAC.

FIG. 53C shows that the TniQ dimer is stabilized in a head-to-tail configuration by reciprocal interactions mediated by the HTH domain and the TniQ-domains from both monomers.

FIG. 55A is a gold standard FSC curve using half maps; the global resolution estimation is 2.9 Å by the FSC 0.143 criterion. FIG. 55B is a cross-validation model-vs-map FSC. Blue curve, FSC between the shacked model refined against half map 1; red curve, FSC against half map 2, not included in the refinement; black curve, FSC between final model against the final map. The overlap observed between the blue and red curves guarantees a non-overfitted model. FIG. 55C left, is an unsharpened map colored according to local resolutions, as reported by RESMAP. dsDNA is visible at the top right projecting outside of the complex. FIG. 54C, right, is the final model colored according to B-factors calculated by REFMAC.

FIGS. 57A-57F are the pairwise sequence identities between C2c5 homologs.

FIGS. 58A-58C is the analysis of the C2c5 genomic loci of the C2c5 homologs from FIG. 57.

FIG. 62 is a multiple sequence alignment of TniQ/TnsD from Vch, *Vibrio cholerae* (SEQ ID NO: 147); Ecl, *Enterobacter cloacae* (SEQ ID NO: 1727); Asa, *Aeromonas salmonicida* (SEQ ID NO: 1728); Pmi, *Proteus mirabilis* (SEQ ID NO: 1729); Eco, *Escherichia coli* (SEQ ID NO: 1726). VchTniQ is aligned to members of the TniQ/TnsD family. Conserved zinc finger motif residues are indicated with blue arrows.

FIG. 63 is a multiple sequence alignment of Cas6 from Vch, *Vibrio cholerae* (SEQ ID NO: 153); Rho, *Rhodanobacter* sp (SEQ ID NO: 1730); Bpl, *Burkholderia plantarii* (SEQ ID NO: 1731); Idi, *Idiomarina* sp. H105 (SEQ ID NO: 1732); Pae, *Pseudomonas aeruginosa* (SEQ ID NO: 1733). VchCas6 is aligned to other I-F Cas6 proteins, which are often annotated as Cas6f or Csy4. Conserved catalytic residues are indicated with red arrows.

FIG. 72 are graphs of the relative integration efficiencies for members of the 'Right Flank Two Binding Sites' library (library b). The two different orientations in which the transposon can integrate are shown in blue (T-RL (tRL), top) and red (T-LR (tLR), bottom). The relative integration efficiency was calculated against variant END. 1.2.3. In this library, the location of two TnsB binding sites in the right end were maintained but their identities were changed to create all possible combinations of the binding sites. Apart from the six different TnsB binding site identities, the location of a palindromic sequence that is naturally present just inside of the transposon right end was also tested. These seven different sequences were numbered 1-7, as in FIG. 71. The x-axis shows which TnsB binding site identity (1-7) was present in position 1, and 2, counting from the terminal transposon right end (see FIG. 68).

FIGS. 80A and 80B shows the vector approach for RNA-guided DNA integration experiments involving CRISPR-transposon homologs. The gRNA and all protein components were expressed from pCQT (denoting the three modules present: CRISPR array, tniQ-cas8-cas7-cas6 genes, and tnsA-tnsB-tnsB genes), in which a single T7 promoter drives expression of a longer mRNA that encodes the precursor guide RNA and all seven proteins components (FIG. 80A). pCQT (the single-expression effector plasmid) was combined with pDonor (FIG. 80A), which contains the DNA cargo flanked by the transposon end sequences, left (L) and right (R). The two vectors encoded spectinomycin and carbenicillin resistance. FIG. 80B is a list of organisms from which the engineered CRISPR-transposon systems were derived. The column on the left indicates the organism information; the second column contains identifier information for the plasmid used for pCQT for each system (SEQ ID NOs: 855, 1623, 1624, 1625, 1626, 1627, 1628, 1903, 1629, 1904, 1905, 1630, 1906, 1907, 1908, respectively); and the third column contains identifier information for the plasmid used for pDonor for each system (SEQ ID NOs: 1614, 1615, 1616, 1617, 1618, 1619, 1620, 1897, 1621, 1898, 1899, 1622, 1900, 1901, 1902, respectively). Each pair of pCQT and pDonor plasmids may be paired, because the transposon end sequences on pDonor are recognized specifically by protein components on the cognate pCQT vector. The CRISPR transposon systems from *Aliivibrio wodanis* and *Parashewanella spongiae* encode a tnsA-tnsB fusion protein.

FIG. 82A is a schematic of the experiment, in which target-4 within the *E. coli* lacZ gene is targeted for proximal DNA integration. The mini-transposon donor DNA can insert in one of two orientations, tRL (top, bottom) and tLR (bottom, bottom), and distinct primer pairs are used to detect each of the orientations by PCR. FIG. 82B is the PCR analysis of *E. coli* BL21(DE3) cells transformed with the plasmids shown in the legend. For each experiment, the cells were transformed with both plasmids, grown on LB-agar plates containing inducer, and then cells were scraped, lysates were prepared, and PCR analyses were performed to detect integration products. PCR reactions were resolved by 1% agarose gel electrophoresis. The top left panel shows results for primer pairs designed to amplify tRL products; the bottom left panel shows results for the exact same set of lysates, but with primer pairs designed to amplify tLR products. The reactions tested CRISPR-transposon homologs from the following organisms: 1) negative control for the system from *Vibrio cholerae* strain HE-45, but lacking pDonor; 2) *Vibrio cholerae* strain HE-45; 3) *Vibrio cholerae* strain 4874; 4) *Photobacterium iliopiscarium* strain NCIMB; 5) *Pseudoalteromonas* sp. P1-25; 6) *Pseudoalteromonas ruthenica* strain S3245; 7) *Photobacterium ganghwense* strain JCM; 8) *Shewanella* sp. UCD-KL21; 9) *Vibrio cholerae* strain OYP7G04; 10) *Vibrio cholerae* strain M1517. FIG. 82C is the PCR analysis of *E. coli* BL21(DE3) cells transformed with the plasmids shown in the legend. For each experiment, the cells were transformed with both plasmids, grown on LB-agar plates containing inducer, and then cells were scraped, lysates were prepared, and PCR analyses were performed to detect integration products. PCR reactions were resolved by 1% agarose gel electrophoresis. The top left panel shows results for primer pairs designed to amplify tRL products; the bottom left panel shows results for the exact same set of lysates, but with primer pairs designed to amplify tLR products. The reactions tested CRISPR-transposon homologs from the following organisms: 1) *Vibrio diazotrophicus* strain 60.6 F; 2) *Vibrio* sp. 16; 3) *Vibrio* sp. F12; 4) *Vibrio splendidus* strain UCD-SED10; 5) *Aliivibrio wodanis* 06/09/160; 6) *Parashewanella spongiae* strain HJ039. Note that the CRISPR-transposon systems in reaction numbers/lanes 5 and 6 encode a TnsA-TnsB fusion protein. * denotes a non-specific PCR amplicon.

FIG. 83A is a schematic representation of the different exemplary vector layouts. Experiments are either done with an all-in-one vector (pAIO, top) or with a vector expressing the machinery (pCCT, middle) in combination with a separate donor vector (pDonor, bottom). The left and right transposon end sequences are represented with an 'L' and 'R', respectively. FIG. 83B are the plasmid ID's for exemplified vectors used for testing a type V CRISPR-Cas associated transposon from *Scytonema hofinannii* strain PCC 7110: pSL1117 (SEQ ID NO: 1767), pSL1114 (SEQ ID NO: 1632), and pSL0948 (SEQ ID NO: 1631). 'NT/cloning' indicates that these plasmids encode a full-length sgRNA but that the guide has no target in *E. coli* and is therefore non-targeting (NT). Additionally, these vectors enable facile cloning of new guide sequences.

FIGS. 84A-84D show RNA-guided DNA integration using a Type V system. FIG. 84 A is a schematic of an exemplary for separately targeting four different sites on lacZ and one upstream in the cynX gene. Integration events were analyzed using a combination of a genome-specific primer with one of two transposon-specific primers to pull out the different orientations in which the mini-transposon can integrate. FIG. 84B shows the analysis by PCR and subsequent agarose gel electrophoresis revealing successful site-specific integration for all four guides tested with a bias towards integrating in the tLR orientation over the tRL orientation. FIG. 84C is a graph of the quantitative analysis completed using qPCR at the different target sites. These data corroborated the orientation bias uncovered FIG. 84B and showed efficient integration for all targeting guides tested. FIG. 84D is a schematic and the results from a proof of principle experiment proving that an all-in-one version of the system also facilitates RNA-guided DNA integration.

FIG. 86A is a schematic overview of the process of RNA-guided DNA integration, involving DNA targeting by a CRISPR-Cas system, and integration of donor DNA proximal to the target site by a transposon system. FIG. 86B is a schematic of the targeting of a 32-bp genomic target site flanked by a protospacer adjacent motif (PAM) by the type I-F variant CRISPR-Cas system leads to integration of the donor DNA ~47-51 bp downstream. The donor DNA can be inserted in one of two potential orientations, denoted by the order of transposon ends closest to the target site; thus, tRL results from the right end of the transposon being inserted proximally to the target site, whereas tLR results from the left end of the transposon being inserted proximally to the target site. FIG. 86C is schematics for the three-plasmid system for reconstituting RNA-guided DNA integration. pQCascade encodes the gRNA, driven by a T7 promoter, as well as TniQ, Cas8, Cas7, and Cas6 from a single operon, also driven by T7 promoter. pTnsABC encodes TnsA, TnsB, and TnsC within a single operon, driven by a T7 promoter. pDonor contains the donor DNA flanked by transposon end sequences. FIG. 86D is schematics of a two-plasmid system for reconstituting RNA-guided DNA integration. pCQT encodes the gRNA and all 7 protein components under control of a single T7 promoter. A single transcriptional terminator lies at the 3' end of the operon. The donor DNA is still encoded on pDonor (pSL1119). FIG. 86E is a schematic of a single engineered all-in-one (AIO) plasmid system for reconstituting RNA-guided DNA integration. pAIO encodes the gRNA and all 7 protein components, as also contains the donor DNA. FIG. 86F is a schematic demonstrating how a single long transcript derived from pCQT/pAIO, which contains the precursor CRISPR RNA 5' of the single-operon mRNA, can be easily processed by Cas6 in Type I CRISPR-Cas systems into the mature gRNA (also referred to as CRISPR RNA, or crRNA), leaving the downstream mRNA intact for translation by the ribosome. FIG. 86G is a schematic demonstrating how a single long transcript derived from pCQT/pAIO, which contains the precursor CRISPR RNA 3' of the single-operon mRNA, can be easily processed by Cas6 in Type I CRISPR-Cas systems into the mature gRNA (also referred to as CRISPR RNA, or crRNA), leaving the upstream mRNA intact for translation by the ribosome. pCQT in panel D is exemplified by pSL1022 (SEQ ID NO: 855) (All plasmid sequences can be found in SEQ ID NOs: 9, 848-861, and 1746-1764); pDonor in panels C and D are exemplified by pSL1119 (SEQ ID NO: 1755).

FIGS. 87A and 87B show the optimization of engineered vectors containing fewer vector and promoter elements. FIG. 87A (left panel) is a schematic overview of iterative screening of engineered vectors in which expression of the gRNA and TniQ-Cas8-Cas7-Cas6 operon is driven by one single T7 promoter rather than two separate T7 promoters. The three derivative plasmids (pQCascade, pQCascade-B, and pQCascade-C) were cloned and tested for RNA-guided DNA integration in conjunction with pTnsBC and pDonor in *E. coli* BL21(DE3) cells. All three plasmid exhibit similar activities (FIG. 87A, right panel), indicating that a single T7 promoter can drive efficient production of all the necessary molecular components. FIG. 87B (left panel) is a schematic overview of iterative screening of engineered vectors in which expression of the gRNA and TniQ-Cas8-Cas7-Cas6-TnsA-TnsB-TnsC operon is driven by a single T7 promoter rather than two or three T7 promoters. The vectors pC7QT, pCQT, pT7QC, and pTQC were cloned, which have variable orders of components and numbers of T7 promoters, and then tested for RNA-guided DNA integration in *E. coli* BL21(DE3) cells. FIG. 87B, right panel is a graph of the quantified integration efficiencies (measured by qPCR). pCQT has an improved efficiency compared with the other vectors. In FIG. 87A: pQCascade=pSL0828 (SEQ ID NO:14), pQCascade-B=pSL1016 (SEQ ID NO: 849), pQCascade-C=pSL1018 (SEQ ID NO: 851), pTnsABC=pSL0283 (SEQ ID NO: 6), pDonor=pSL1119 (SEQ ID NO: 1755). In FIG. 87B: pC7QT=pSL1020 (SEQ ID NO: 853), pCQT=pSL1022 (SEQ ID NO: 855), pT7QC=pSL1024 (SEQ ID NO: 857), pTQC=pSL1026 (SEQ ID NO: 859)

FIG. 88C shows the assessment of genome-wide RNA-guided DNA insertion specificity by Tn-seq for the engineered all-in-one (pAIO) vectors. After performing Tn-seq based experiments to assess genome-wide specificity, the percent on-target integration was calculated by considering the number of reads mapping to the on-target integration site, versus the total number of genome mapping reads. All five gRNAs within the pAIO vector backbone directed integration at ~100% on-target specificities. In panel A: "pCDF" is exemplified by pSL1213 (SEQ ID NO: 1751), "pUC19" is exemplified by pSL1121 (SEQ ID NO: 861), "pSC101" is exemplified by pSL1220 (SEQ ID NO: 1752), "pBBR1" is exemplified by pSL1222 (SEQ ID NO: 1753).

FIG. 90A shows that starting with the all-in-one pAIO plasmid containing the inducible T7 promoter, the promoter was replaced with various synthetic biology promoters of variable expression strength (J series), as well as either the lac promoter or a broad host-range promoter derived from a previous study developing methods for in situ bacterial engineering using conjugative plasmids (Ronda, C., Chen, S. P., Cabral, V., Yaung, S. J. & Wang, H. H. *Nat Meth* 16, 167-170 (2019), incorporated herein by reference). After cloning the desired plasmids, *E. coli* BL21(DE3) cells were transformed with the pAIO containing the stated promoter, and the efficiency of RNA-guided DNA integration was quantified by qPCR. The strongest J23119 promoter shows optimal activity, and integration efficiency decreases with decreasing promoter strength. Genome-wide specificity measurements using Tn-seq show that there is no change in genome-wide specificity with variable expression levels of the machinery, or with variable absolute integration efficiencies (FIG. 90B). Using the all-in-one pAIO vectors containing variable promoter strengths, RNA-guided DNA integration assays were performed in which the transformed *E. coli* cells were cultured at either 37° C. (red), 30° C. (yellow) or 25° C. (blue). Integration efficiencies (FIG. 90B) were then quantified after 24 hours of solid media culturing by qPCR. The results demonstrate that low-efficiency constructs, such as the weak J23114 promoter which is low-activity at 37° C., achieve ~100% integration efficiency when the cells were cultured at lower temperatures. These experiments provide a facile experimental strategy for elevating the efficiency of integration under vector or promoter conditions that are otherwise non-ideal at elevated temperature. In panel A: "J23119" is exemplified by pSL1130 (SEQ ID NO: 864), "J23114" is exemplified by pSL1133 (SEQ ID NO: 867), "MAGIC-1" is exemplified by pSL1279 (SEQ ID NO: 1750). In panel C: T7-lacO is exemplified by pSL1213 (SEQ ID NO: 1751), "J23119" is exemplified by pSL1130(SEQ ID NO: 864), "J23114" is exemplified by pSL1133 (SEQ ID NO: 867).

FIG. 96A outlines an exemplary workflow for studying immunity. In the left, a genome is subjected to RNA-guided DNA integration using a temperature sensitive all-in-one plasmid (pAIO-ts), such that the cells can be cured of the plasmid after the successful integration event. These cells are then made chemically competent, and subjected to another round of transformation in which the protein-RNA machinery is delivered (pCQT) alongside a distinct traceable pDonor molecule. If the system exhibits target immunity, then the same target site should be unable to serve as an efficient receiver of another donor DNA molecule. FIG. 96B shows exemplary experiments to test the distance range of target immunity. Starting with a cell strain containing genomically integrated donor DNA (an "immunized" state), pCQT was transformed with a gRNA targeting variable target sites upstream of the pre-existing donor DNA, ranging from 0-5003 bp, all the way up to a target site that is >1 Mb from the first donor DNA site. Then, the relative efficiency of integration was calculated, by measuring the local integration efficiency in a naïve WT strain by qPCR, as well as the efficiency of integration in the immunized strain by qPCR. The ratio was plotted, and the results indicated that target immunity can operate at long distance scales, relative to the distance between target DNA binding and donor DNA integration. In another embodiment (FIG. 96C), the machinery encoded by pCQT is delivered to an immunized strain, but without another copy of pDonor. In this embodiment, the machinery can excise the donor DNA from its pre-existing site in the genome, and mobilize it to a new target site based on the spacer content within pCQT. This embodiment offers a method for making programmed translocation within cells, provided they have a pre-existing donor DNA with transposon ends recognized by the CRISPR-transposon system. pAIO-ts in panel A is exemplified by pSL1223 (SEQ ID NO: 1754). pCQT in panels is exemplified by pSL1022 (SEQ ID NO: 855).

FIG. 97A is a schematic of orthogonal RNA-guided integrases. A type I-F variant CRISPR-transposon system derived from *Vibrio cholerae* strain HE-45 (left) used to reconstitute RNA-guided DNA integration in *E. coli* with a pDonor plasmid and a pCQT expression plasmid. A Type V CRISPR-transposon system derived from *Scytonema hofmannii* strain PCC 7110 (right) is used to reconstitute RNA-guided DNA integration in *E. coli* using a pDonor plasmid (Sho-pDonor) and a plasmid encoding the sgRNA under control of a T7 promoter and the Cas12k-TnsB-TnsC-TniQ operon under control of a second T7 promoter (Sho-PCCT). Experiments were performed to investigate whether Vch-pCQT can mobilize the Sho-pDonor donor DNA, and whether Sho-pCCT can mobilize the Vch-pDonor donor DNA. The plasmids shown above the gel were used in various combinations to transform *E. coli* BL21(DE3) cells, and primer pairs were used to detect RNA-guided DNA integration products; different primer pairs were chosen to selectively amplify a tRL product or a tLR product. The results (FIG. 97B) clearly indicate that, while Vch-pCQT catalyzed RNA-guided DNA integration using its own Vch-Donor donor DNA, it was unable to direct RNA-guided DNA integration using the Sho-Donor donor DNA; the converse was also true. However, both systems were able to catalyze efficient and robust RNA-guided DNA integration when the expression plasmid is paired with the cognate donor DNA plasmid. In panel A: Vch-pCQT is exemplified by pSL1022 (SEQ ID NO: 855), Vch-pDonor is exemplified by pSL1119 (SEQ ID NO: 1755), Sho-pCCT is exemplified by pSL1115, Sho-pDonor is exemplified by pSL0948 (SEQ ID NO: 1631).

FIG. 98C shows the PCR analysis of RNA-guided DNA integration in the indicated bacterial species (top), analyzed by agarose gel electrophoresis. Data for gRNAs targeting one of two target genes is shown in the gel (see gene labels in the top part of panel), and cell lysates were probed with one of four primer pairs, a, b, c, and d. The bands in the top part of the gel indicate robust RNA-guided DNA integration, which was confirmed by subsequent Sanger sequencing analysis. The PCRs on the above of the gel amplify a reference housekeeping gene, and are present as a loading control for the lysate preparation. Genomic DNA was purified from the transformed cells, and subjected to Tn-seq analysis of the genome-wide specificity of RNA-guided DNA integration. For both *Klebsiella oxytoca* and *Pseudomonas putida*, Tn-seq analysis demonstrated that ~95-100% of integration events occur at the anticipated target site, with the same distance rules that were previously observed in *E. coli* (FIG. 98D). For the two *P. putida* guides that showed much lower specificity, these could be ascribed to highly similar off-target sequences elsewhere in the genome. pAIO-BBR1 constructs used for *K. oxytoca* is exemplified by pSL1813 (SEQ ID NO: 1761). pAIO-BBR1 constructs used for *P. putida* is exemplified by pSL1802 (SEQ ID NO: 1760).

Figure 99A:
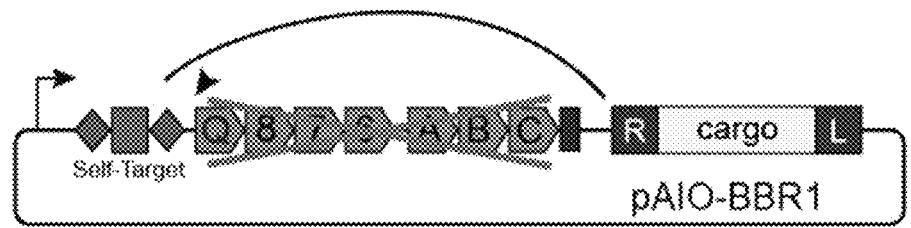
Figure 99B:
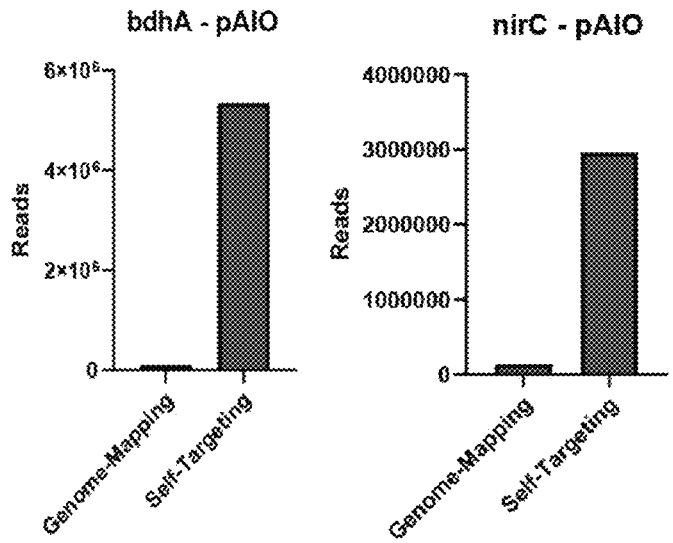
Figure 99C:
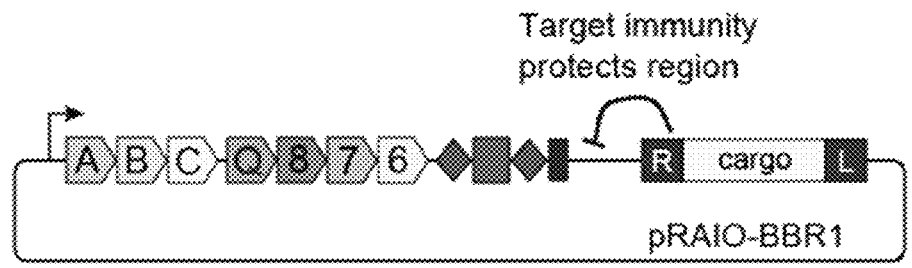
Figure 99D:
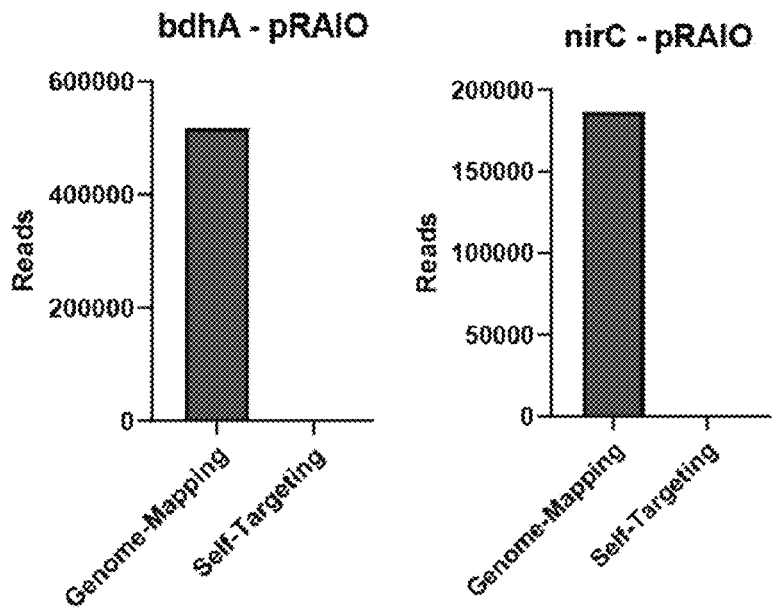
Figure 99E:
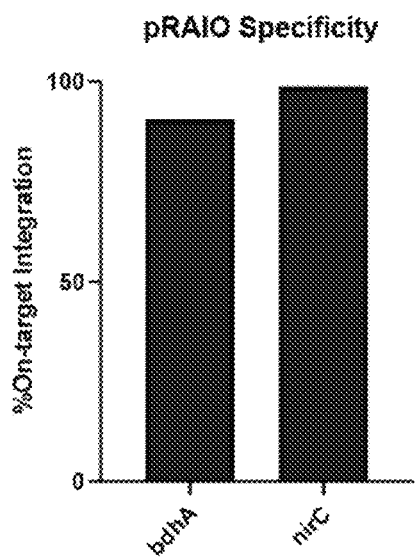

FIGS. 99A-99E show methods for avoiding self-inactivation of CRISPR-transposon systems. Because the CRISPR-transposon system derived from *Vibrio cholerae* strain HE-45 can target the self-PAM sequence within the 3' end of the CRISPR array repeat sequence (5'-AC-3'), albeit with low efficiency, the system is susceptible to self-inactivation. Namely, if the machinery promiscuously targets the self-target (which encodes the gRNA) present within the CRISPR array itself, the integration of the donor DNA downstream could inactivate the machinery (suggested with the red X in FIG. 99A) and/or cause instability of the plasmid. This effect is mitigated under conditions where maintaining the plasmid incurs a fitness cost on cells, or in cases where the desired RNA-guided DNA integration event incurs a fitness cost on cells. Experiments targeting both bdhA and nirC for insertional inactivation using the engineered CRISPR-transposon system, via RNA-guided DNA integration, showed clear evidence of self-inactivation of the system through self-targeting (FIG. 99B). By analyzing Tn-seq data, which provides unbiased assessment of all integration sites genome-wide, a massive overabundance of reads were found resulting from self-targeting of the CRISPR-encoded spacer, relative to the scant number of reads mapping to the genome. To circumvent this problem, a reverse-orientation all-in-one plasmid was cloned on the pBBR1 backbone (denoted pRAIO-BBR1), in which the CRISPR array is now at the 3' end of the polycistronic construct, following the mRNA protein encoding TnsA-TnsB-TnsC-TniQ-Cas8-Cas7-Cas6 (FIG. 99C). This alternative orientation placed the self-target in close proximity to the donor DNA on the pRAIO-BBR1 vector, and thus, may repress any escaping self-targeting because of the target immunity mechanism. When the experiments from FIG. 99B were repeated, but using the new pRAIO-BBR1 vectors, the self-inactivation problem was completely eliminated; all reads mapped to the target site in the genome, and there were no reads whatsoever resulting from self-inactivation and RNA-guided DNA integration downstream of the CRISPR array. This engineered system was therefore desirable for use in experiments where cells have a fitness benefit in inactivating the CRISPR-transposon system. To further confirm the utility of the engineered pRAIO-BBR1 vectors, the percent of all Tn-seq reads mapping to the on-target site were plotted (FIG. 99E), and it was found that for both of the difficult-to-knockout genes, the newly engineered pRAIO-BBR1 vectors performed with excellent on-target specificity. pAIO-BBR1 is exemplified by pSL1802 (SEQ ID NO: 1760), pRAIO-BBR1 is exemplified by pSL1780 (SEQ ID NO: 1763).

FIGS. 100A-100J are tables of guide RNAs and genomic target sites. * Coordinates are for the *E. coli* BL21(DE3) genome (GenBank accession CP001509). t PAM sequences denote the 2 nucleotides immediately 5' of the target (*V. cholerae* and *P. aeruginosa* Cascade) or 3 nucleotides immediately 3' of the target (*S. pyogenes* Cas9) on the non-target strand.

FIGS. 101A-101C are tables of oligonucleotides used for PCR (FIG. 101A), qPCR (FIG. 101B), and NGS (FIG. 101C).

FIGS. 102A-102C are tables of prospective CRISPR-transposon systems.

Figure 103A:
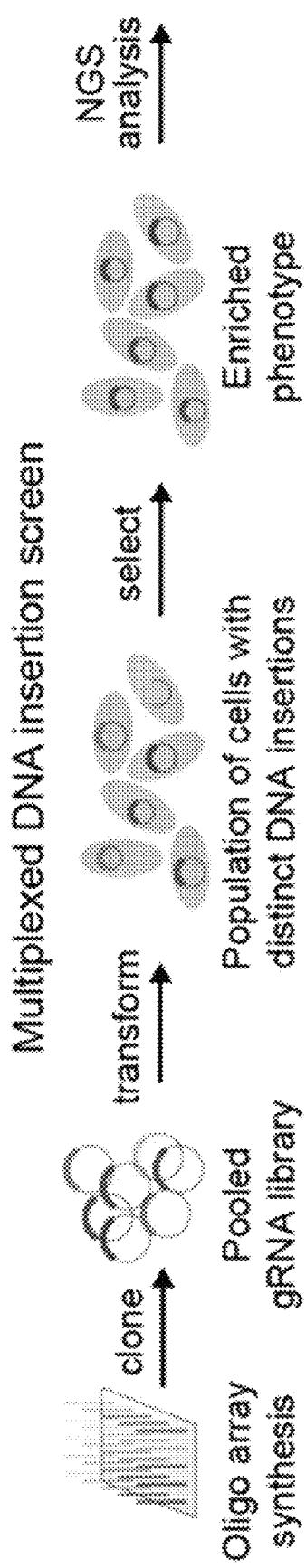
Figure 103C:
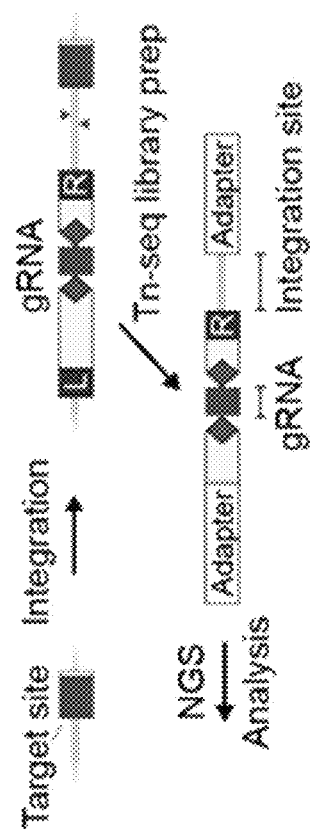
Figure 103B:
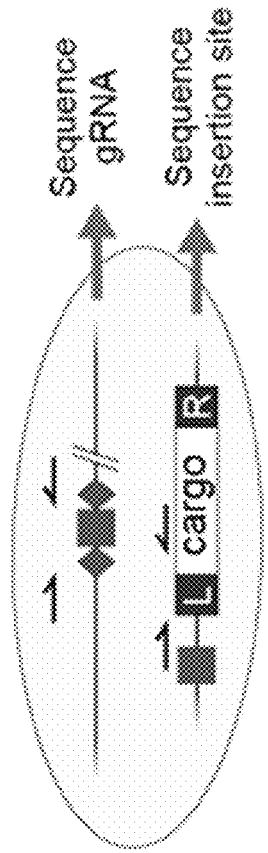

FIGS. 103A-103C show the generation of pooled gRNA libraries for libraries of RNA-guided DNA integration events across a population of cells. FIG. 103A shows that gRNA libraries are cloned by designing and synthesizing oligo array libraries containing the spacers, or guide sequences, of interest. Using standard molecular biology and molecular cloning methods, these oligos are converted into double-stranded DNA and cloned into expression plasmids within the CRISPR array, such that transcription of the CRISPR array produces gRNAs or gRNA precursors that are processed by Cas6 into mature gRNAs. The expression plasmids may contain the CRISPR array only, or the CRISPR array and one or more protein-coding genes, such as genes involved in RNA-guided DNA integration. The CRISPR array may also be contained within the donor DNA itself. The pooled gRNA library plasmids are then used to transform target cells of interest, leading to a corresponding library of distinct RNA-guided DNA insertion events across the population of cells. In an optional next step, the population of cells may be subjected to a selection step, thereby enriching a phenotype of interest procued by the insertion library. Finally, sequencing or next-generation sequencing (NGS) is used to identify gRNAs from the pooled library that caused the phenotype of interest. In one embodiment of this process, the pooled gRNA library is initially generated in plasmid DNA, and then converted into a lentiviral gRNA library for experiments in eukaryotic cells. Cells (FIG. 103B) from the pooled library experiment will contain the CRISPR array with one of the members of the gRNA library, as well as an insertion of donor DNA proximal to the target site complementary to the gRNA. The gRNA locus, or the insertion site, or both, may be sequenced. FIG. 103C is a schematic of one embodiment in which the CRISPR array encoding the gRNA is inserted directly within the donor DNA cargo. In another embodiment, pooled gRNA libraries are cloned within the donor DNA cargo. In this embodiment, RNA-guided DNA integration leads to preservation of the gRNA within the donor DNA, such that information about the gRNA that drove DNA insertion to that particular genomic region is preserved within the donor element itself. NGS analysis of the insertion site, for example by transposon-insertion sequencing, is then used to extract both the integration site as well as the gRNA information.

Figure 104A:
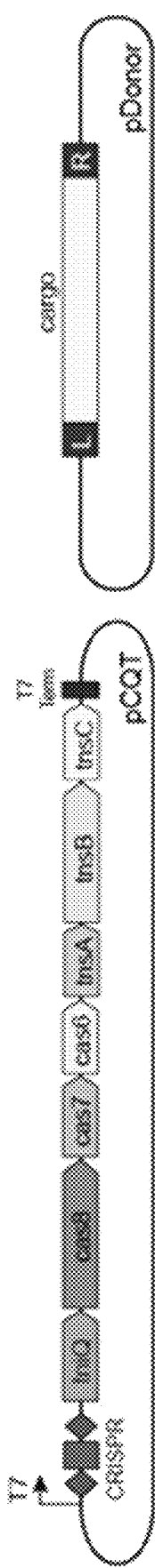
Figure 104B:
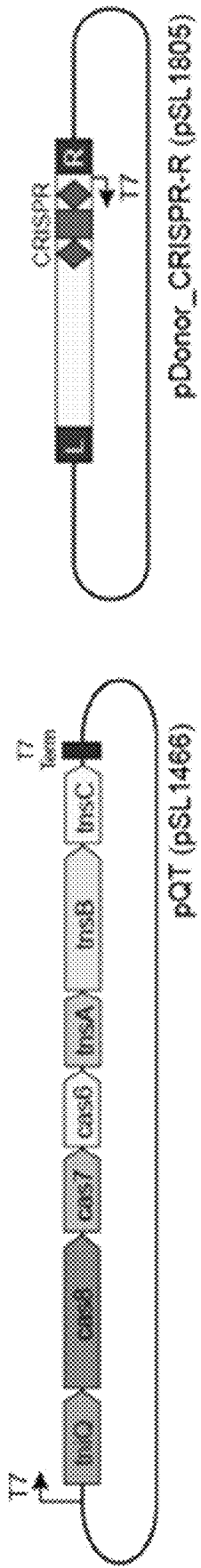
Figure 104C:
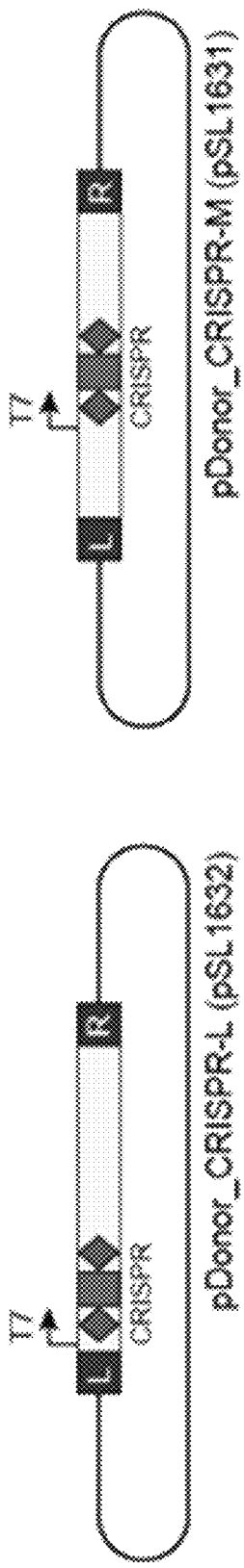
Figure 104D:
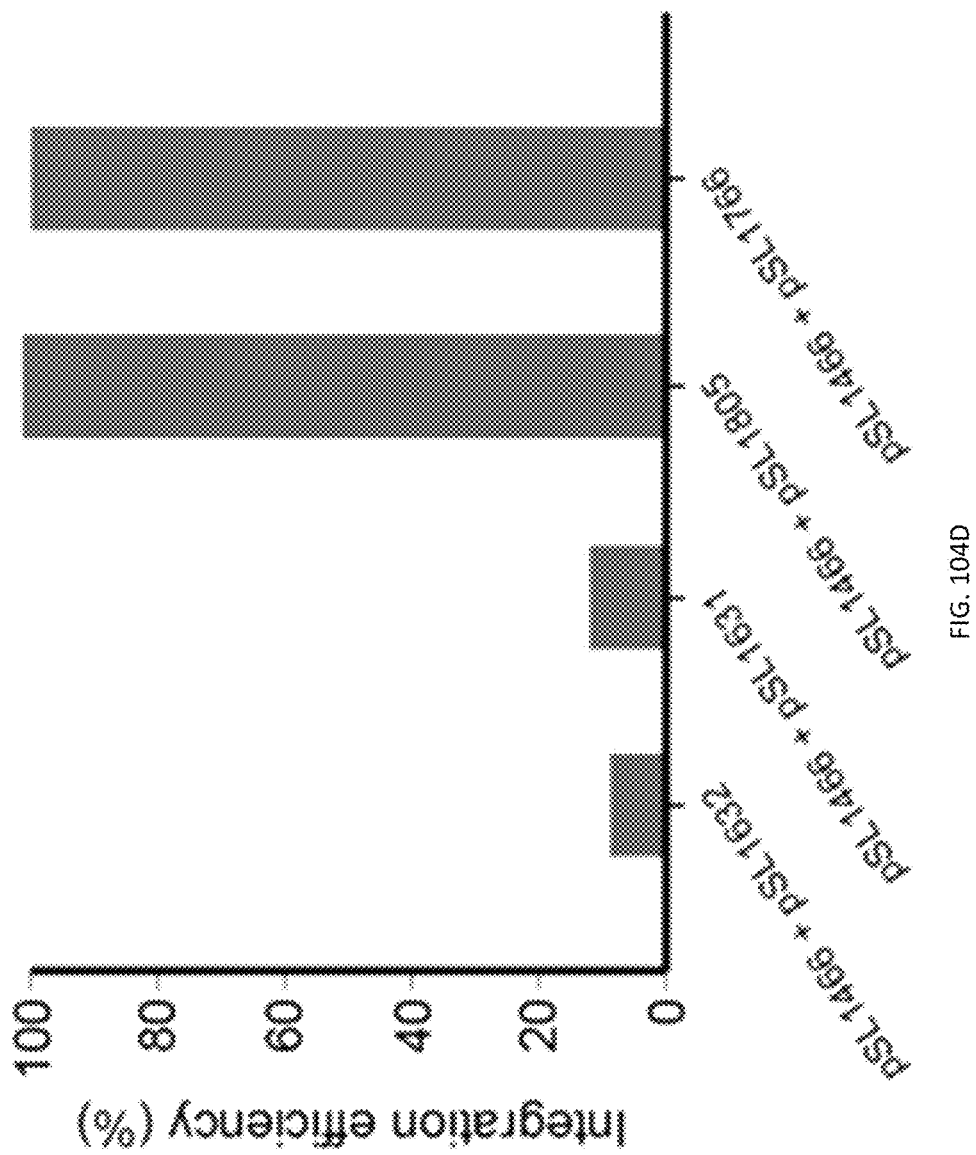

FIGS. 104A-104D show that donor DNA-encoded gRNAs direct efficient RNA-guided DNA integration. FIG. 104A is a schematic of an engineered two-plasmid system for RNA-guided DNA integration. The effector plasmid (pCQT; exemplified by pSL1022, SEQ ID NO: 855) encodes the gRNA (via the CRISPR array) as well as all the protein components, in this embodiment comprising TniQ-Cas8-Cas7-Cas6-TnsA-TnsB-TnsC. The Donor plasmid (pDonor; exemplified by pSL0527, SEQ ID NO: 7) contains the donor DNA flanked by transposon left and right ends. FIG. 104B is a schematic of a modified engineered two-plasmid system for RNA-guided DNA integration. The effector plasmid (pQT; exemplified by pSL1466, SEQ ID NO: 2001) encodes all the protein components, in this embodiment comprising TniQ-Cas8-Cas7-Cas6-TnsA-TnsB-TnsC. The Donor_CRISPR plasmid (pDonor_CRISPR-R, exemplified by pSL1805, SEQ ID NO: 2002) contains the donor DNA flanked by transposon left and right ends; the CRISPR array, encoding the gRNA, is contained within the cargo donor DNA itself near the transposon right end. In another embodiment, the pDonor_CRISPR plasmid has an additional removal of lac operator sequence downstream of the T7 promoter (exemplified by pSL1766, SEQ ID NO: 2005). FIG. 104C is a schematic of modified versions of pDonor_CRISPR contain the CRISPR array near either the left transposon end (pSL1632, SEQ ID NO: 2003) or near the middle of the cargo (pSL1631, SEQ ID NO: 2004). FIG. 104D is a graph of the RNA-guided DNA integration activity in *E. coli* BL21(DE3) cells using a gRNA targeting lacZ. The identity of the two plasmids used in each experiment are listed below the bar graph. Integration efficiency was quantified by qPCR, using cell lysate after overnight culturing on solid LB-agar media. The pDonor_CRISPR-R plasmids are far more efficient, wherein the CRISPR array is contained near the right transposon end.

DETAILED DESCRIPTION

In certain embodiments, the present systems and methods use Tn7-like transposons that encode CRISPR-Cas systems for programmable, RNA-guided DNA integration. Specifically, the CRISPR-Cas machinery directs the Tn7 transposon-associated proteins to integrate DNA downstream of a target site (e.g., a genomic target site) recognized by a guide RNA (gRNA).

1. RNA-Guided DNA Integration

The RNA-guided transposase mechanism for gene integration does not proceed through a double-strand break (DSB) intermediate, and thus does not result in non-homologous end joining (NHEJ)-mediated insertions or deletions. Rather, targeting of the DNA leads to direct integration through a concerted transesterification reaction, without any off-pathway alternatives. As the targeting relies on the gRNA, the present methods and systems obviate the need for homology arms to be redesigned for every new target site.

For therapeutic purposes, the gRNA may be designed to target a specific gene or chromosomal region, such as a gene or chromosomal region associated with a disease, disorder, or condition.

The present systems and methods may result in any desired effect. In one embodiment, the present systems and methods may result in decreased transcription of a target gene.

The present system and methods may target any target site, or insert a donor DNA at any site, within a DNA, e.g., in a coding or non-coding region, within or adjacent to a gene, such as, for example, a leader sequence, trailer sequence or intron, or within a non-transcribed region, either upstream or downstream of the coding region. A target site or target sequence may comprise any polynucleotide, such as DNA or RNA polynucleotides.

The present RNA-guided DNA integration system and methods allows DNA integration in various types of cells, including post-mitotic cells and non-dividing cells, such as neurons and terminally differentiated cells. Thus, also provided is a cell comprising the present RNA-guided DNA integration system.

The present system and methods may be derived from a bacterial or archaeal transposon that harbor a CRISPR-Cas system, such as a Tn7-like transposon. In one embodiment, the Tn7-like transposon system is derived from *Vibrio cholerae* Tn6677. The system can encompass gain-of-function Tn7 mutants (Lu et al. EMBO 19(13):3446-3457 (2000); U.S. Patent Publication No. 20020188105) as well as replicative Tn7 transposition mutants (May et al. Science 272: 401-404 (1996)). The Tn7-like transposons include, but are not limited to, the Tn6677 transposon from *Vibrio cholerae*, the Tn5090/Tn5053 transposon, the Tn6230 transposon, and the Tn6022 transposon. See, Peters et al., Recruitment of CRISPR-Cas systems by Tn7-like transposons, *Proc Natl Acad Sci USA* 114, E7358-E7366 (2017). Peters, J. E. Tn7. *Microbiol Spectr* 2 (2014).

Tn7-like transposons may encode various types of CRISPR-Cas systems, such as Type I CRISPR-Cas systems (such as subtypes I-B, I-F (including I-F variants)), and Type V CRISPR-Cas systems (such as V-U5).

In certain embodiments, the present system and methods may comprise a Type I CRISPR-Cas system. Type I systems may comprise a multi-subunit effector complex, such as the Cascade or Csy complex. In one embodiment, the Cascade complex is derived from a *Vibrio cholerae* Tn7 transposon comprising the type I-F Cascade and the TniQ protein. TniQ may bridge the CRISPR-Cas machinery with the Tn7-associated machinery for DNA integration. The present system may be nuclease deficient. In one embodiment, the Tn7-associated Type I-F system may lack the Cas3 nuclease.

The Cascade complex in canonical I-F CRISPR-Cas systems is encoded by four genes, designated cas8 (or csy1), cas5 (or csy2), cas7 (or csy3), and cas6 (or csy4); each gene may also be further classified with a subtype-specific qualifier, as in cas8f, cas5f, cas7f, and cas6f.

In one embodiment, the Tn7-like transposon comprises a Type I-F variant CRISPR-Cas systems, whose genes encode a Cascade complex. The Tn7-like transposon contains the tnsA-tnsB-tnsC operon, whereas the tnsD homolog known as tniQ is encoded within the operon that encodes the Cas8/Cas5 fusion-Cas7-Cas6 proteins that collectively form the RNA-guided TniQ-Cascade complex. The TnsA and TnsB protein products mediate transposon excision, whereas TnsB mediates integration of the transposon into the target DNA.

The Tn7-like transposon may comprise the transposases TnsA and TnsB. TnsA and TnsB may form a heteromeric transposase. TnsB is a DDE-type transposase that catalyzes concerted breakage and rejoining reactions, joining the 3'-hydroxyl of the donor ends to the 5'-phosphate groups at the insertion site of the target DNA. TnsA structurally resembles a restriction endonuclease, and carries out the nicking reaction on the opposite strand of the donor DNA molecule. Accessory protein TnsC may modulate the activity of the heteromeric TnsAB transposase. TnsC may activate transposition when complexed with a target DNA and a target selection protein, TnsD or TnsE. TnsC variants may promote transposition in the absence of TnsD or TnsE. In certain embodiments, wildtype or variants of TnsA, TnsB, and/or TnsC may be used in the present system and method, including variants with deletions, insertions, or amino acid substitutions compared to the wildtype proteins. The present system may include one or more of the following variants: TnsA S69N, TnsA E73K, TnsA A65V, TnsA E185K, TnsA Q261Z, TnsA G239S, TnsA G239D, TnsA Q261Z, TnsB M366I, TnsB A325T, and TnsB A325V (see, Lu et al., (EMBO J. 9(3):3446-57, 2000)).

In one embodiment, the present engineered transposon-encoded CRISPR-Cas system is derived from *V. cholerae* HE-45 (designated Tn6677, registered with the Transposon Registry). See, Roberts et al. Revised nomenclature for transposable genetic elements, Plasmid 60, 167-173 (2008). Tn6677 refers to the native *V. cholerae* transposon sequence, and miniaturized transposon constructs comprising the transposon ends and artificial cargos are designated as mini-Tn6677, or mini-transposons (mini-Tn) more generally. The CRISPR-Cas system found within Tn6677 is a I-F variant system, and the Cascade operon comprises a cas8-cas5 fusion gene (which is also referred herein as cas8), cas7, and cas6, along with the upstream tniQ gene. Expression of transposon- and CRISPR-associated machineries in trans serves to transpose mini-Tn6677 from a vector comprising a donor DNA to the DNA integration site.

In one embodiment, the present system and methods comprise engineered *V. cholerae* Tn7 transposon, which comprises TnsA, TnsB, TnsC, TniQ, Cas8/Cas5 fusion, Cas7, Cas6, and at least one gRNA.

In certain embodiments, the present system and methods may comprise a Type V CRISPR-Cas system. Type V systems belong to the Class 2 CRISPR-Cas systems, characterized by a single-protein effector complex that is programmed with a gRNA. In one embodiment, the present Tn7-like transposons comprise Type V-U5 systems, which encode an enzyme such as C2c5 (S. Shmakov et al., Nat Rev Microbiol. 15, 169-182 (2017)). The present system may be nuclease deficient. In one embodiment, the present system lacks TnsA (lacks the tnsA gene).

C2c5 may be from *Geminocystis* sp. NIES-3709 (NCBI accession ID: WP_066116114.1). The transposon-associated Type V CRISPR-Cas systems may be derived from: *Anabaena variabilis* ATCC 29413 (or *Trichormus variabilis* ATCC 29413 (see GenBank CP000117.1)), *Cyanobacterium aponinum* IPPAS B-1202, *Filamentous cyanobacterium* CCP2, *Nostoc punctiforme* PCC 73102, and *Scytonema hofmannii* PCC 7110.

In one embodiment, the present system and methods comprise engineered Tn7-like transposons that encode Type V-U5 CRISPR-Cas systems, which comprises TnsB, TnsC, TniQ, C2c5, and at least one gRNA.

The term "transposon" encompasses a DNA segment with cis-acting sites (which may contain heterologous DNA sequences), and the genes that encode trans-acting proteins that act on those cis-acting sites to mobilize the DNA segment defined by the sites, regardless of how they are organized in DNA. The present transposons, such as the Tn7-like transposons, also encode a CRISPR-Cas system. An entire transposon is not necessary to practice the present method. Thus, the term "transposon derivative", "transposable element", or "insertable element" as used herein can also refer to DNA minimally comprising the cis-acting sites at which the trans-acting proteins act to mobilize the segment defined by the sites. It is also understood that the sites may contain a heterologous DNA. The proteins may be provided in the form of nucleic acids (DNA or RNA encoding the proteins) or in the form of proteins (e.g., purified proteins).

As used herein, the term "Tn7 transposon" refers to the prokaryotic transposable element Tn7, and their modified forms or transposons sharing homology with Tn7 transposons ("Tn7-like transposons"). Tn7 has been most commonly studied in *Escherichia coli*. "Tn7 transposon" can encompass forms of DNA that do not demonstrably contain Tn7 genes, but which can be made to undergo transposition through use of the Tn7 gene products TnsA and TnsB, which collaborate to form the Tn7 transposase, or modifications thereof. Such DNA is bounded by 5' and 3' DNA sequences recognizable by the transposase, which can function as the transposon end sequences. Examples of Tn7 transposon end sequences may be found in Arciszewska et al. (1991) J Biol Chem 266: 21736-44 (PMID: 1657979), Tang et al. (1995) Gene 162: 41-6 (PMID: 7557414), Tang et al. (1991) Nucleic Acids Res 19: 3395-402 (PMID: 1648205), Biery et al. (2000) Nucleic Acids Res 28: 1067-77 (PMID: 10666445), Craig (1995) Cur Top Microbiol Immunol 204: 27-48 (PMID: 8556868), and other published sources, and should allow transposition given the appropriate Tns proteins. Without wishing to be bound by any theory, it is believed that the transposon ends are opposed to the donor DNA by TnsA and TnsB. These two Tns proteins are believed to then collaborate to execute the breakage and joining reactions that underlie transposition.

The Tn7 transposon contains characteristic left and right transposon end sequences and encodes five tns genes, tnsA-E, which collectively encode a heteromeric transposase, TnsA and TnsB which are catalytic enzymes that excise the transposon donor via coordinated double-strand breaks; TnsB, a member of the retroviral integrase superfamily, catalyzes DNA integration; TnsD and TnsE constitute mutually exclusive targeting factors that specify DNA integration sites; and TnsC is an ATPase that communicates between TnsAB and TnsD or TnsE. TnsD mediates site-specific Tn7 transposition into a conserved Tn7 attachment site (attTn7) downstream of the glmS gene in *E. coli*, whereas TnsE mediates random transposition into the lagging-strand template during replication. In *E. coli*, site-specific transposition involves attTn7 binding by TnsD, followed by interactions with the TnsC regulator protein to directly recruit the TnsA-TnsB-donor DNA. TnsC, TnsD, and TnsE interact with the target DNA to modulate the activity of the transposase via two distinct pathways. TnsABC+TnsD directs transposition to attTn7, a discrete site on the *E. coli* chromosome, at a high frequency, and to other loosely related "pseudo att" sites at low frequency. The alternative combination TnsABC+E directs transposition to many unrelated non-attTn7 sites in the chromosome at low frequency and preferentially to conjugating plasmids. Thus, attTn7 and conjugable plasmids contain positive signals that recruit the transposon to these target DNAs. The alternative target site selection mechanisms enable Tn7 to inspect a variety of potential target sites in the cell and select those most likely to ensure its survival.

As used herein, the term "transposase" refers to an enzyme that catalyzes transposition.

As used herein, the term "transposition" refers to a complex genetic rearrangement process, involving the movement of a DNA sequence from one location and insertion into another, for example between a genome and a DNA construct such as a plasmid, a bacmid, a cosmid, and a viral vector.

The present disclosure provides for an engineered transposon-encoded CRISPR-Cas system for RNA-guided DNA integration in a cell, comprising: (i) at least one Cas protein, (ii) a guide RNA (gRNA), and (iii) a Tn7-like transposon system.

Also encompassed by the present disclosure is a system and methods for RNA-guided DNA integration in a cell, comprising: (i) one or more vectors encoding an engineered CRISPR-Cas system, wherein the CRISPR-Cas system comprises: (a) at least one Cas protein, and (b) a guide RNA (gRNA); and (ii) one or more vectors encoding a Tn7-like transposon system, wherein the CRISPR-Cas system and the transposon system are on same or different vector(s).

The present disclosure provides for an engineered transposon-encoded CRISPR-Cas system and methods for RNA-guided DNA integration in a cell, comprising: (i) at least one Cas protein, (ii) a guide RNA (gRNA), and (iii) an engineered transposon system.

The present disclosure also provides for a system and methods for RNA-guided DNA integration in a cell, comprising: (i) one or more vectors encoding an engineered CRISPR-Cas system, wherein the CRISPR-Cas system comprises: (a) at least one Cas protein, and (b) a guide RNA (gRNA); and (ii) one or more vectors encoding an engineered transposon system, wherein the CRISPR-Cas system and the transposon system are on same or different vector(s).

The present disclosure provides for a method for RNA-guided DNA integration in a cell, the method comprising introducing into the animal cell an engineered transposon-encoded CRISPR-Cas system, wherein the transposon-encoded CRISPR-Cas system comprises: (i) at least one Cas protein, (ii) a guide RNA (gRNA) specific for a target site, (iii) an engineered transposon system, and (iv) a donor DNA, wherein the transposon-encoded CRISPR-Cas system integrates the donor DNA proximal to the target site.

The present system and methods may comprise TnsD or TniQ. The present system may comprise TnsA, TnsB and TnsC. The present system may comprise TnsB and TnsC.

The present system and methods may be derived from a Class 1 CRISPR-Cas system. The present and methods may be derived from a Class 2 CRISPR-Cas system. The present and methods may be derived from a Type I CRISPR-Cas system (such as subtypes I-B, I-F (including I-F variants)). The present and methods may be derived from a Type V CRISPR-Cas system (such as V-U5). The present and methods may be derived from a Type II CRISPR-Cas system (such as II-A).

The present system may be nuclease-deficient. The present system and methods may comprise Cas6, Cas7 and Cas5 and Cas8, separately or as a fusion protein. The present system and methods may comprise Cas9.

The present system and methods may comprise a Cascade complex. The present system may comprise C2c5.

The transposon-encoded CRISPR-Cas system may integrate the donor DNA into the genome of the cell.

The present system and methods may further comprise a donor DNA, wherein the donor DNA comprises a cargo nucleic acid flanked by transposon end sequences. The transposon end sequences on either end may be the same or different. The transposon end sequence may be the endogenous Tn7 transposon end sequences or may include deletions, substitutes or insertions. The endogenous Tn7 transposon end sequences may be truncated. In some embodiments, the transposon end sequence includes an about 40 base pair (bp) deletion relative to the endogenous Tn7 transposon end sequence. In some embodiments, the transposon end sequence includes an about 100 base pair deletion relative to the endogenous Tn7 transposon end sequence. The deletion may be in the form of a truncation at the distal (in relation to the cargo) end of the transposon end sequences.

The integration may be about 40 bp to about 60 bp, about 46 bp to about 55 bp, about 47 bp to about 51 bp, about 48 bp to about 50 bp, about 43 bp to about 57 bp, about 45 bp to about 50 bp, about 48 bp, about 49 bp, or about 50 bp, downstream (3') of the target site.

The target site may be flanked by a protospacer adjacent motif (PAM).

The present disclosure provides for systems and methods for transient expression or stable integration of the DNA or polynucleotide(s) encoding one or more components of the present system.

The present systems and methods may be specific for one target site, or may be specific for 2, 3, 4, 5, 6, 7, 8, 9, 10 or more target sites.

In certain embodiments, the present system and methods may act through a cut-and-paste mechanism (e.g., Type I-F CRISPR-Cas systems, such as systems derived from *E. coli* Tn7 or *V. cholerae* Tn6677). In certain embodiments, the present system and methods may act through a copy-and-paste mechanism (or replicative transposition) (e.g., Type V CRISPR-Cas systems containing C2c5 (Cas12k)).

The present system and methods may act through a cut-and-paste mechanism, where the donor DNA is fully excised from the donor site and inserted at the target location (Bainton et al., Cell, 1991; 65 (5), pp. 805-816). TnsA and TnsB cleave both strands of the transposon DNA at both ends, leading to clean excision of a linear dsDNA, which contains short 3-nucleotide 5'-overhangs on both ends (not shown). The free 3'-OH ends are then used as a nucleophile by TnsB to attack phosphodiester bonds on both strands of the target DNA, resulting in concerted transesterification reactions. After gap fill-in, the transposition reaction is complete, and the integrated transposon is flanked by 5-bp target site duplications (TSD) on both ends as a result of the gap fill-in reaction.

The present system and methods may act through a copy-and-paste mechanism, also known as replicative transposition. This results when the 5' ends of the transposon donor DNA are not broken during the excision step, as is the case when the tnsA endonuclease gene is absent from the gene operon encoding the transposition proteins. In this case, the 3'-OH ends are still liberated and can participate in staggered transesterification reactions with the target DNA, catalyzed by TnsB, but the 5' ends of the transposon remain covalently linked to the remainder of the DNA within the donor DNA molecule, which can be a genome or a plasmid vector. This copy-and-paste reaction results in what's known as a Shapiro intermediate, in which the entirety of the donor DNA, including the transposon sequence itself, as well as the flanking sequences, is joined together with the broken target DNA. This intermediate can only be resolved during subsequent DNA replication, which results in a so-called cointegrate product. This cointegrate harbors two copies of the transposon itself, flanked by the TSD on one side. Importantly, the cointegrate also harbors the entirety of the donor DNA molecule, as well as the entirety of the target DNA molecule. Thus, in cases where the transposon is encoded on a plasmid vector, the entirety of the vector is joined to the target DNA during replicative transposition. At some frequency, the cointegrate product can be resolved into the products shown at the right, either through the action of a dedicated resolvase protein (e.g. the TniR protein in Tn5090/Tn5053), or through endogenous homologous recombination because of extensive homology between the two copies of the transposon itself in the cointegrate product. Cointegrate resolution results in a target DNA harboring a single transposon flanked by the TSD, as well as a regenerated version of the donor DNA molecule.

In one embodiment, the present system and methods comprise a Tn7 transposon or Tn7-like transposon where there is a single point mutation in the TnsA active site (TnsA D114A). DNA breakage may occur at the 3' end of each strand of the donor (May and Craig. Science, 1996; 272 (5260):401-4). Without full excision of the donor DNA, the system switches to a replicative copy-and-paste mechanism, resulting in a cointegrate product that eventually is resolved by recombination to yield two identical copies of the cargo. In another embodiment, the present system comprises Tn7 transposon or Tn7-like transposon where there is a single point mutation (D90A) in the *V. cholerae* TnsA protein (TnsA D90A). In yet another embodiment, in order to increase the efficiency of recombination and resolution of the cointegrate product, the cargo includes a site-specific recombinase (such as Cre or CinH), along with its recognition sequence. In naturally occurring replicative transposons such as Tn3 and Mu, this recombinase-assisted strategy has been shown to be utilized for resolution of the cointegrate (Nicolas et al. Microbiology Spectrum. 2015; 3(4)).

In some embodiments, the Cas proteins, the Tns proteins, and the nucleic acid encoding the gRNA are provided on the same nucleic acid (e.g., a vector). In some embodiments, the Cas proteins, the Tns proteins, and the nucleic acid encoding the gRNA are provided on different nucleic acids (e.g., different vectors), for example, on 2, 3, 4, 5, 6, or more vectors. Alternatively, or in addition, the Cas proteins and/or the Tns proteins may be provided or introduced into the cell in protein form.

In some embodiments, the nucleotide sequence encoding the Cas proteins and/or the Tns proteins may be codon optimized for expression in a host cell. In some embodiments, one or more of the Cas proteins and/or the Tns proteins is a homolog or ortholog of the wildtype protein.

In some embodiments, the nucleotide sequence encoding a Cas protein and/or a Tns protein is modified to alter the activity of the protein. Alternatively, or in addition, a Cas protein and/or a Tns protein may be fused to another protein or portion thereof. In some embodiments, a Cas protein and/or a Tns protein is fused to a fluorescent protein (e.g., GFP, RFP, mCherry, etc.). In some embodiments, a Cas protein and/or a Tns protein fused to fluorescent proteins are used for labeling and/or visualization of genomic loci or identifying cells expressing the protein.

In certain embodiments, the present system comprises one or more vectors DNAs or polynucleotides which comprise one or more nucleotide sequences selected from SEQ ID Nos: 1-139, and equivalents thereof. In certain embodiments, the present system comprises one or more vectors which comprise one or more nucleotide sequences about 80% to about 100% identical to the nucleotide sequences selected from in SEQ ID Nos: 1-139. The vector may comprise a nucleotide sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to any of the nucleotide sequences set forth in SEQ ID Nos: 1-139.

In certain embodiments, the present system and methods comprise one or more vectors, DNAs or polynucleotides having one or more nucleotide sequences selected from SEQ ID NO: 140 (TnsA), SEQ ID NO: 142 (TnsB), SEQ ID NO: 144 (TnsC), SEQ ID NO: 146 (TniQ), SEQ ID NO: 148 (Cas8/Cas5 fusion), SEQ ID NO: 150 (Cas7), SEQ ID NO: 152 (Cas6), and equivalents thereof. In certain embodiments, the present system comprises one or more vectors, DNAs or polynucleotides which comprise one or more nucleotide sequences about 80% to about 100% identical to the nucleotide sequences selected from SEQ ID NO: 140, SEQ ID NO: 142, SEQ ID NO: 144, SEQ ID NO: 146, SEQ ID NO: 148, SEQ ID NO: 150, and SEQ ID NO: 152. The vector may comprise a nucleotide sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to any of the nucleotide sequences set forth in SEQ ID NO: 140, SEQ ID NO: 142, SEQ ID NO: 144, SEQ ID NO: 146, SEQ ID NO: 148, SEQ ID NO: 150, and SEQ ID NO: 152.

In certain embodiments, the present system and methods comprise one or more proteins having one or more amino acid sequences selected from SEQ ID NO: 141 (TnsA), SEQ ID NO: 143 (TnsB), SEQ ID NO: 145 (TnsC), SEQ ID NO: 147 (TniQ), SEQ ID NO: 149 (Cas8/Cas5 fusion), SEQ ID NO: 151 (Cas7), SEQ ID NO: 153 (Cas6), and equivalents thereof. In certain embodiments, the present system comprises one or more proteins which comprise one or more amino acid sequences about 80% to about 100% identical to the amino acid sequences selected from SEQ ID NO: 141 (TnsA), SEQ ID NO: 143 (TnsB), SEQ ID NO: 145 (TnsC), SEQ ID NO: 147 (TniQ), SEQ ID NO: 149 (Cas8), SEQ ID NO: 151 (Cas7), and SEQ ID NO: 153 (Cas6). The protein may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to any of the amino acid sequences set forth in SEQ ID NO: 141 (TnsA), SEQ ID NO: 143 (TnsB), SEQ ID NO: 145 (TnsC), SEQ ID NO: 147 (TniQ), SEQ ID NO: 149 (Cas8), SEQ ID NO: 151 (Cas7), and SEQ ID NO: 153 (Cas6).

In one embodiment, the present system and methods comprise a nucleotide sequence encoding TnsA, where the nucleotide sequence is SEQ ID NO: 140 or an equivalent thereof. The nucleotide sequence encoding TnsA may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 140.

The amino acid sequence of TnsA may comprise the amino acid sequence set forth in SEQ ID NO: 141 or an equivalent thereof. The amino acid sequence of TnsA may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 141.

In one embodiment, the present system and methods comprise a nucleotide sequence encoding TnsB, where the nucleotide sequence is SEQ ID NO: 142 or an equivalent thereof. The nucleotide sequence encoding TnsB may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 142.

The amino acid sequence of TnsB may comprise SEQ ID NO: 143 or an equivalent thereof. The amino acid sequence of TnsB may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 143.

In one embodiment, the present system and methods comprise a nucleotide sequence encoding TnsC, where the nucleotide sequence is SEQ ID NO: 144 or an equivalent thereof. The nucleotide sequence encoding TnsC may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 144.

The amino acid sequence of TnsC may comprise SEQ ID NO: 145 or an equivalent thereof. The amino acid sequence of TnsC may comprise an amino acid sequence about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 145.

In one embodiment, the present system and methods comprise a nucleotide sequence encoding TniQ, where the nucleotide sequence is SEQ ID NO: 146 or an equivalent thereof. The nucleotide sequence encoding TniQ may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 146.

The amino acid sequence of TniQ may comprise SEQ ID NO: 147 or an equivalent thereof. The amino acid sequence of TniQ may comprise an amino acid sequence about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 147.

In one embodiment, the present system and methods comprise a nucleotide sequence encoding Cas8 (Cas5/Cas8), where the nucleotide sequence is SEQ ID NO: 148 or an equivalent thereof. The nucleotide sequence encoding Cas8 (Cas5/Cas8) may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 148.

The amino acid sequence of Cas8 (Cas5/Cas8) may comprise SEQ ID NO: 149 or an equivalent thereof. The amino acid sequence of Cas8 (Cas5/Cas8) may comprise an amino acid sequence about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 149.

In one embodiment, the present system and methods comprise a nucleotide sequence encoding Cas7, where the nucleotide sequence is SEQ ID NO: 150 or an equivalent thereof. The nucleotide sequence encoding Cas7 may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 150.

The amino acid sequence of Cas7 may comprise SEQ ID NO: 151 or an equivalent thereof. The amino acid sequence of Cas7 may comprise an amino acid sequence about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 151.

In one embodiment, the present system and methods comprise a nucleotide sequence encoding Cas6, where the nucleotide sequence is SEQ ID NO: 152 or an equivalent thereof. The nucleotide sequence encoding Cas6 may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 152.

The amino acid sequence of Cas6 may comprise SEQ ID NO: 153 or an equivalent thereof. The amino acid sequence of Cas6 may comprise an amino acid sequence about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in SEQ ID NO: 153.

In one embodiment, the present system and methods comprise a nucleotide sequence encoding TnsA, where the nucleotide sequence is selected from SEQ ID NOs: 768, 1777, 1786, 1795, 1804, 1813, 1822, 1831, 1909, 1925, 1941, 1957, or an equivalent thereof. The nucleotide sequence encoding TnsA may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1768, 1777, 1786, 1795, 1804, 1813, 1822, 1831, 1909, 1925, 1941, and 1957.

The amino acid sequence of TnsA may comprise the amino acid sequence set forth in any of SEQ ID NOs: 1714-1717, 1840, 1847, 1854, 1861, 1868, 1875, 1882, 1889, 1896, 1918, 1934, 1950, 1966, or an equivalent thereof. The amino acid sequence of TnsA may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1714-1717, 1840, 1847, 1854, 1861, 1868, 1875, 1882, 1889, 1896, 1918, 1934, 1950, or 1966.

In one embodiment, the present system and methods comprise a nucleotide sequence encoding TnsB, where the nucleotide sequence is selected from SEQ ID NOs: 1769, 1778, 1787, 1796, 1805, 1814, 1823, 1832, 1910, 1926, 1942, 1958, or an equivalent thereof. The nucleotide sequence encoding TnsB may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1769, 1778, 1787, 1796, 1805, 1814, 1823, 1832, 1910, 1926, 1942, and 1958.

The amino acid sequence of TnsB may comprise the amino acid sequence set forth in any of SEQ ID NOs: 1841, 1848, 1855, 1862, 1869, 1876, 1883, 1890, 1919, 1935, 1951, 1967, or an equivalent thereof. The amino acid sequence of TnsB may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1841, 1848, 1855, 1862, 1869, 1876, 1883, 1890, 1919, 1935, 1951, or 1967.

In one embodiment, the present system and methods comprise a nucleotide sequence encoding TnsA/TnsB fusion, where the nucleotide sequence is selected from SEQ ID NOs: 1973, 1987, or an equivalent thereof. The nucleotide sequence encoding TnsA/TnsB fusion may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1973 and 1987.

The amino acid sequence of TnsA/TnsB fusion may comprise the amino acid sequence set forth in any of SEQ ID NOs: 1981, 1995, or an equivalent thereof. The amino acid sequence of TnsA/TnsB fusion may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1981 and 1995.

In one embodiment, the present system and methods comprise a nucleotide sequence encoding TnsC, where the nucleotide sequence is selected from SEQ ID NOs: 1770, 1779, 1788, 1797, 1806, 1815, 1824, 1833, 1911, 1927, 1943, 1959, 1974, 1988, or an equivalent thereof. The nucleotide sequence encoding TnsC may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1770, 1779, 1788, 1797, 1806, 1815, 1824, 1833, 1911, 1927, 1943, 1959, 1974, and 1988.

The amino acid sequence of TnsC may comprise the amino acid sequence set forth in any of SEQ ID NOs: 1842, 1849, 1856, 1863, 1870, 1877, 1884, 1891, 1920, 1936, 1952, 1968, 1982, 1996, or an equivalent thereof. The amino acid sequence of TnsC may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1842, 1849, 1856, 1863, 1870, 1877, 1884, 1891, 1920, 1936, 1952, 1968, 1982, and 1996.

In one embodiment, the present system and methods comprise a nucleotide sequence encoding TniQ, where the nucleotide sequence is selected from SEQ ID NOs: 1771, 1780, 1789, 1798, 1807, 1816, 1825, 1834, 1912, 1928, 1944, 1960, 1975, 1989, or an equivalent thereof. The nucleotide sequence encoding TniQ may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1771, 1780, 1789, 1798, 1807, 1816, 1825, 1834, 1912, 1928, 1944, 1960, 1975, and 1989.

The amino acid sequence of TniQ may comprise the amino acid sequence set forth in any of SEQ ID NOs: 1843, 1850, 1857, 1864, 1871, 1878, 1885, 1892, 1921, 1937, 1953, 1969, 1983, 1997, or an equivalent thereof. The amino acid sequence of TniQ may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1843, 1850, 1857, 1864, 1871, 1878, 1885, 1892, 1921, 1937, 1953, 1969, 1983, and 1997.

In one embodiment, the present system and methods comprise a nucleotide sequence encoding Cas7, where the nucleotide sequence is selected from SEQ ID NOs: 1773, 1782, 1791, 1800, 1809, 1818, 1827, 1836, 1914, 1930, 1946, 1962, 1977, 1998, or an equivalent thereof. The nucleotide sequence encoding Cas7 may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1773, 1782, 1791, 1800, 1809, 1818, 1827, 1836, 1914, 1930, 1946, 1962, 1977, and 1998.

The amino acid sequence of Cas7 may comprise the amino acid sequence set forth in any of SEQ ID NOs: 1845, 1852, 1854, 1866, 1873, 1880, 1887, 1899, 1923, 1939, 1955, 1971, 1958, 1999, or an equivalent thereof. The amino acid sequence of Cas7 may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1845, 1852, 1854, 1866, 1873, 1880, 1887, 1899, 1923, 1939, 1955, 1971, 1958, and 1999.

In one embodiment, the present system and methods comprise a nucleotide sequence encoding Cas6, where the nucleotide sequence is selected from SEQ ID NOs: 1774, 1783, 1792, 1801, 1810, 1819, 1828, 1837, 1915, 1931, 1947, 1963, 1978, 1992 or an equivalent thereof. The nucleotide sequence encoding Cas6 may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1774, 1783, 1792, 1801, 1810, 1819, 1828, 1837, 1915, 1931, 1947, 1963, 1978, and 1992.

The amino acid sequence of Cas6 may comprise the amino acid sequence set forth in any of SEQ ID NOs: 1846, 1853, 1860, 1867, 1874, 1881, 1888, 1895, 1924, 1940, 1956, 1972, 1986, 2000, or an equivalent thereof. The amino acid sequence of Cas6 may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1846, 1853, 1860, 1867, 1874, 1881, 1888, 1895, 1924, 1940, 1956, 1972, 1986, and 2000.

In one embodiment, the present system and methods comprise a nucleotide sequence encoding Cas8/Cas5 fusion, where the nucleotide sequence is selected from SEQ ID NOs: 1772, 1781, 1790, 1799, 1808, 1817, 1826, 1835, 1913, 1929, 1945, 1961, 1976, 1990, or an equivalent thereof. The nucleotide sequence encoding Cas8/Cas5 may be about 80% to about 100%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1772, 1781, 1790, 1799, 1808, 1817, 1826, 1835, 1913, 1929, 1945, 1961, 1976, and 1990.

The amino acid sequence of Cas8/Cas5 may comprise the amino acid sequence set forth in any of SEQ ID NOs: 1844, 1851, 1858, 1865, 1872, 1879, 1886, 1893, 1922, 1938, 1954, 1970, 1984, 1998, or an equivalent thereof. The amino acid sequence of Cas8/Cas5 may comprise an amino acid sequence at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, or about 100%, identical to the amino acid sequence set forth in any of SEQ ID NOs: 1844, 1851, 1858, 1865, 1872, 1879, 1886, 1893, 1922, 1938, 1954, 1970, 1984, and 1998.

The present system and methods may comprise (i) one or more vectors encoding the engineered CRISPR-Cas system, and, (ii) one or more vectors encoding the engineered transposon system, wherein the CRISPR-Cas system and the transposon system are on the same vector or on at least two different vectors. In one embodiment, a fist vector encodes TnsB, TnsC, and TniQ (e.g., pTnsBCQ); a second vector encodes C2c5 (e.g., pC2c5); a third vector encodes a donor DNA (e.g., pDonor).

The proteins of the present system and methods include the wildtype proteins as well as any substantially homologous proteins and variants of the wildtype proteins. The term "variant" of a protein is intended to mean a protein derived from the native protein by deletion (truncation), addition, and/or substitution of one or more amino acids in the native protein. Such variants may result from, for example, genetic polymorphism or from human manipulation. A variant of a native protein can be "substantially homologous" to the native protein when at least about 80%, at least about 90%, or at least about 95% of its amino acid sequence is identical to the amino acid sequence of the native protein.

The present systems and methods provide for the insertion of a nucleic acid into any DNA segment of any organism. Moreover, the present systems and methods also provide for the insertion into any synthetic DNA segment.

Also provided is a self-transposable nucleic acid comprising a mobile nucleic acid sequence encoding a transposon-encoded CRISPR-cas system, as described above, and a first and second transposon end sequences that flank said mobile nucleic acid sequence. The cargo nucleic acid of the transposon-encoded CRISPR-cas system may also be flanked by transposon end sequences. The self-transposable nucleic acid may be in a vector. A "vector" or "expression vector" is a replicon, such as plasmid, phage, virus, or cosmid, to which another DNA segment, e.g. an "insert," may be attached or incorporated so as to bring about the replication of the attached segment in a cell. The self-transposable nucleic acid may be present in genomic DNA of a cell.

a. Donor DNA

The donor DNA may be a part of a bacterial plasmid, bacteriophage, plant virus, retrovirus, DNA virus, autonomously replicating extra chromosomal DNA element, linear plasmid, mitochondrial or other organelle DNA, chromosomal DNA, and the like. The donor DNA comprises a cargo nucleic acid sequence flanked by transposon end sequences.

The donor DNA, and by extension the cargo nucleic acid, may of any suitable length, including, for example, about 50-100 bp (base pairs), about 100-1000 bp, at least or about 10 bp, at least or about 20 bp, at least or about 25 bp, at least or about 30 bp, at least or about 35 bp, at least or about 40 bp, at least or about 45 bp, at least or about 50 bp, at least or about 55 bp, at least or about 60 bp, at least or about 65 bp, at least or about 70 bp, at least or about 75 bp, at least or about 80 bp, at least or about 85 bp, at least or about 90 bp, at least or about 95 bp, at least or about 100 bp, at least or about 200 bp, at least or about 300 bp, at least or about 400 bp, at least or about 500 bp, at least or about 600 bp, at least or about 700 bp, at least or about 800 bp, at least or about 900 bp, at least or about 1 kb (kilobase pair), at least or about 2 kb, at least or about 3 kb, at least or about 4 kb, at least or about 5 kb, at least or about 6 kb, at least or about 7 kb, at least or about 8 kb, at least or about 9 kb, at least or about 10 kb, or less than 10 kb, in length or greater. The donor DNA, and the cargo nucleic acid, may be at least or about 10 kb, at least or about 50 kb, at least or about 100 kb, between 20 kb and 60 kb, between 20 kb and 100 kb.

b. CRISPR

CRISPR-Cas system has been successfully utilized to edit the genomes of various organisms, including, but not limited to bacteria, humans, fruit flies, zebra fish and plants. See, e.g., Jiang et al., Nature Biotechnology (2013) 31(3):233; Qi et al, Cell (2013) 5:1173; DiCarlo et al., Nucleic Acids Res. (2013) 7:4336; Hwang et al., Nat. Biotechnol (2013), 3:227); Gratz et al., Genetics (2013) 194:1029; Cong et al., Science (2013) 6121:819; Mali et al., Science (2013) 6121: 823; Cho et al. Nat. Biotechnol (2013) 3: 230; and Jiang et al., Nucleic Acids Research (2013) 41(20):e188.

The present system may comprise Cas6, Cas7 Cas5, and Cas8. In some embodiments, the Cas5 and Cas8 are linked as a functional fusion protein. The present system may comprise Cas9.

The present system may be derived from a Class 1 CRISPR-Cas system. The present system may be derived from a Class 2 CRISPR-Cas system. The present system may be derived from a Type I CRISPR-Cas system. The present system may be derived from a Type II CRISPR-Cas system. The present system may be derived from a Type V CRISPR-Cas system.

The present system may comprise a Cascade complex. The present system may comprise C2c5.

c. gRNA

The gRNA may be a crRNA/tracrRNA (or single guide RNA, sgRNA).

The terms "gRNA," "guide RNA" and "CRISPR guide sequence" may be used interchangeably throughout and refer to a nucleic acid comprising a sequence that determines the binding specificity of the CRISPR-Cas system. A gRNA hybridizes to (complementary to, partially or completely) a target nucleic acid sequence (e.g., the genome) in a host cell. The gRNA or portion thereof that hybridizes to the target nucleic acid (a target site) may be between 15-25 nucleotides, 18-22 nucleotides, or 19-21 nucleotides in length. In some embodiments, the gRNA sequence that hybridizes to the target nucleic acid is 15, 16, 17, 18, 19, 20, 21, 22, 23, 24, or 25 nucleotides in length. In some embodiments, the gRNA sequence that hybridizes to the target nucleic acid is between 10-30, or between 15-25, nucleotides in length. gRNAs or sgRNA(s) used in the present disclosure can be between about 5 and 100 nucleotides long, or longer (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 60, 61, 62, 63, 63, 64, 65, 66, 67, 68, 69, 70, 71, 72, 73, 74, 75, 76, 77, 78, 79, 80, 81, 82, 83, 84, 85, 86, 87, 88, 89, 90, 91 92, 93, 94, 95, 96, 97, 98, 99, or 100 nucleotides in length, or longer). In one embodiment, gRNAs or sgRNA(s) can be between about 15 and about 30 nucleotides in length (e.g., about 15-29, 15-26, 15-25; 16-30, 16-29, 16-26, 16-25; or about 18-30, 18-29, 18-26, or 18-25 nucleotides in length).

To facilitate gRNA design, many computational tools have been developed (See Prykhozhij et al. (PLoS ONE, 10(3): (2015)); Zhu et al. (PLoS ONE, 9(9) (2014)); Xiao et al. (Bioinformatics. Jan. 21 (2014)); Heigwer et al. (Nat Methods, 11(2): 122-123 (2014)). Methods and tools for guide RNA design are discussed by Zhu (Frontiers in Biology, 10 (4) pp 289-296 (2015)), which is incorporated by reference herein. Additionally, there are many publicly available software tools that can be used to facilitate the design of sgRNA(s); including but not limited to, Genscript Interactive CRISPR gRNA Design Tool, WU-CRISPR, and Broad Institute GPP sgRNA Designer. There are also publicly available pre-designed gRNA sequences to target many genes and locations within the genomes of many species (human, mouse, rat, zebrafish, C. elegans), including but not limited to, IDT DNA Predesigned Alt-R CRISPR-Cas9 guide RNAs, Addgene Validated gRNA Target Sequences, and GenScript Genome-wide gRNA databases.

In addition to a sequence that binds to a target nucleic acid, in some embodiments, the gRNA may also comprise a scaffold sequence (e.g., tracrRNA). In some embodiments, such a chimeric gRNA may be referred to as a single guide RNA (sgRNA). Exemplary scaffold sequences will be evident to one of skill in the art and can be found, for example, in Jinek, et al. Science (2012) 337(6096):816-821, and Ran, et al. Nature Protocols (2013) 8:2281-2308.

In some embodiments, the gRNA sequence does not comprise a scaffold sequence and a scaffold sequence is expressed as a separate transcript. In such embodiments, the gRNA sequence further comprises an additional sequence that is complementary to a portion of the scaffold sequence and functions to bind (hybridize) the scaffold sequence.

In some embodiments, the gRNA sequence is at least 50%, 55%, 60%, 65%, 70%, 75%, 80%, 85%, 90%, 95%, 96%, 97%, 98%, 99%, or at least 100% complementary to a target nucleic acid. In some embodiments, the gRNA sequence is at least 50%, 55%, 60%, 65%, 70%, 75%, 80%, 85%, 90%, 95%, 96%, 97%, 98%, 99%, or at least 100% complementary to the 3' end of the target nucleic acid (e.g., the last 5, 6, 7, 8, 9, or 10 nucleotides of the 3' end of the target nucleic acid).

The gRNA may be a non-naturally occurring gRNA.

The target nucleic acid may be flanked by a protospacer adjacent motif (PAM). A PAM site is a nucleotide sequence in proximity to a target sequence. For example, PAM may be a DNA sequence immediately following the DNA sequence targeted by the CRISPR/Cas system.

The target sequence may or may not be flanked by a protospacer adjacent motif (PAM) sequence. In certain embodiments, a nucleic acid-guided nuclease can only cleave a target sequence if an appropriate PAM is present, see, for example Doudna et al., Science, 2014, 346(6213): 1258096, incorporated herein by reference. A PAM can be 5' or 3' of a target sequence. A PAM can be upstream or downstream of a target sequence. In one embodiment, the target sequence is immediately flanked on the 3' end by a PAM sequence. A PAM can be 1, 2, 3, 4, 5, 6, 7, 8, 9, 10 or more nucleotides in length. In certain embodiments, a PAM is between 2-6 nucleotides in length. The target sequence may or may not be located adjacent to a PAM sequence (e.g., PAM sequence located immediately 3' of the target sequence) (e.g., for Type I CRISPR/Cas systems and Type II CRISPR/Cas systems). In some embodiments, e.g., Type I systems, the PAM is on the alternate side of the protospacer (the 5' end). Makarova et al. describes the nomenclature for all the classes, types and subtypes of CRISPR systems (Nature Reviews Microbiology 13:722-736 (2015)). Guide structures and PAMs are described in by R. Barrangou (Genome Biol. 16:247 (2015)).

Non-limiting examples of the PAM sequences include: CC, CA, AG, GT, TA, AC, CA, GC, CG, GG, CT, TG, GA, AGG, TGG, T-rich PAMs (such as TTT, TTG, TTC, TTTT (SEQ ID NO: 385), etc.), NGG, NGA, NAG, NGGNG and NNAGAAW (W=A or T, SEQ ID NO: 912), NNNNGATT (SEQ ID NO: 913), NAAR (R=A or G), NNGRR (R=A or G), NNAGAA (SEQ ID NO: 914) and NAAAAC (SEQ ID NO: 915), where "N" is any nucleotide.

"Complementarity" refers to the ability of a nucleic acid to form hydrogen bond(s) with another nucleic acid sequence by either traditional Watson-Crick or other non-traditional types. A percent complementarity indicates the percentage of residues in a nucleic acid molecule, which can form hydrogen bonds (e.g., Watson-Crick base pairing) with a second nucleic acid sequence. Full complementarity is not necessarily required, provided there is sufficient complementarity to cause hybridization. There may be mismatches distal from the PAM.

d. Transposon

Any Tn7 transposon that encodes CRISPR-Cas systems may be used in the present methods and systems.

For example, Type I Cascade complexes may be used in the present methods and systems. Type I CRISPR-Cas systems encode a multi-subunit protein-RNA complex called Cascade, which utilizes a crRNA (or guide RNA) to target double-stranded DNA during an immune response. Cascade itself has no nuclease activity, and degradation of targeted DNA is instead mediated by a trans-acting nuclease known as Cas3. Intriguingly, the I-F and I-B systems found within Tn7 transposons consistently lack the Cas3 gene, suggesting that these systems no longer retain any DNA degradation capabilities and have been reduced to RNA-guided DNA-binding complexes. Additionally, one of the core proteins used by Tn7 transposons for selection of DNA target sites for purposes of transposon mobility, TnsD (also known as TniQ), is conspicuously encoded by a gene sitting directly within the Cas gene operon in these systems, suggesting direct coupling or functional relationship between the Cascade complex encoded by Cas genes, and the transpososome enzymatic machinery encoded by Tn seven (Tns) transposase genes.

The system derived from Vibrio cholerae that harbors a Type I-F CRISPR-Cas system may be used in the present method. Other systems (for which the CRISPR-Cas systems are either categorized as Type I-F or I-B) may also be used in the present method. These include CRISPR-systems from Vibrio cholerae, Photobacterium iliopiscarium, Pseudoalteromonas sp. P1-25, Pseudoalteromonas ruthenica, Photobacterium ganghwense, Shewanella sp. UCD-KL21, Vibrio diazotrophicus, Vibrio sp. 16, Vibrio sp. F12, Vibrio splendidus, Aliivibrio wodanis, and Parashewanella spongiae.

The Type V systems that encode putative effector gene known as c2c5 may be used in the present methods and systems. The Type V systems encode a putative effector that may be a single protein functioning with a single gRNA. These may have different packaging size, assembly, nuclear localization, etc. Type V CRISPR-Cas systems fall within Class 2 systems, which rely on single-protein effectors together with guide RNA, and so it remains possible that the engineering strategies may be streamlined by using single-protein effectors like C2c5 rather than the multi-subunit protein-RNA complexes encoded by type I systems, namely Cascade. These operons may be cloned into the same backbones.

Any CRISPR-Cas/Tn7 transposons may be used in the present methods and systems. They may have different efficiency, different specificity, different coding size, different PAM specificity, different transposon end sequences, etc.

The present system may comprise TnsD or TniQ. The present system may comprise TnsA, TnsB, and TnsC. The present system may comprise TnsB and TnsC.

e. Vectors

The Cas proteins and/or Tns proteins of the methods and compositions described here can be engineered, chimeric, or isolated from an organism. The Cas proteins and/or Tns proteins can be introduced into the cell in the form of a protein or in the form of a nucleic acid encoding the protein, such as an mRNA or a cDNA.

The present disclosure further provides engineered, non-naturally occurring vectors and vector systems, which can encode one or more components of the present system.

The present system and methods may comprise one or more vectors for RNA-guided DNA integration in prokaryotic cells or eukaryotic cells.

The present system can be delivered to a subject or cell using one or more vectors (e.g., 1, 2, 3, 4, 5, 6, 7, 8, 9, or more vectors). One or more gRNAs (e.g., sgRNAs) can be in a single (one) vector or two or more vectors. The vector may also include a donor DNA. One or more Cas proteins and/or Tns proteins can be in the same, or separate vectors.

Vectors can be administered directly to patients (in vivo) or they can be used to manipulate cells in vitro or ex vivo, where the modified cells may be administered to patients. The vectors of the present disclosure are delivered to the eukaryotic cell in a subject. Modification of the eukaryotic cells via the present system can take place in a cell culture, where the method comprises isolating the eukaryotic cell from a subject prior to the modification. In some embodiments, the method further comprises returning said eukaryotic cell and/or cells derived therefrom to the subject.

Conventional viral and non-viral based gene transfer methods can be used to introduce nucleic acids encoding components of the present system into cells, tissues or a subject. Such methods can be used to administer nucleic acids encoding components of the present system to cells in culture, or in a host organism. Non-viral vector delivery systems include DNA plasmids, cosmids, RNA (e.g., a transcript of a vector described herein), a nucleic acid, and a nucleic acid complexed with a delivery vehicle. Viral vector delivery systems include DNA and RNA viruses, which have either episomal or integrated genomes after delivery to the cell. Viral vectors include, for example, retroviral, lentiviral, adenoviral, adeno-associated and herpes simplex viral vectors.

In certain embodiments, the requisite protein and RNA machinery may be expressed on the same plasmid as the transposon donor, so that the entire system is fully autonomous. The machinery guiding the DNA targeting and DNA integration may be encoded within the transposon itself, such that it can guide further mobilization autonomously, whether in the originally transformed bug, or in other bugs (e.g. in a conjugative plasmid context, in a microbiome context, etc.).

In certain embodiments, the requisite protein and RNA machinery may be expressed on two or more plasmids.

Promoters that may be used include T7 RNA polymerase promoters, constitutive E. coli promoters, and promoters that could be broadly recognized by transcriptional machinery in a wide range of bacterial organisms. The system may be used with various bacterial hosts.

In certain embodiments, plasmids that are non-replicative, or plasmids that can be cured by high temperature may be used. The transposon, and transposon/CRISPR-associated machinery, may be removed from the engineered cells under certain conditions. This may allow for RNA-guided integration by transforming bacteria of interest, but then being left with engineered strains that have no memory of the plasmids used to facilitate RNA-guided DNA integration.

Drug selection strategies may be adopted for positively selecting for cells that underwent RNA-guided DNA integration. A transposon may contain one or more drug-selectable markers within the cargo. Then presuming that the original transposon donor plasmid is removed (by methods described herein), drug selection may be used to enrich for integrated clones.

Colony screenings may be used to isolate clonal events.

A variety of viral constructs may be used to deliver the present system (such as one or more Cas proteins and/or Tns proteins, gRNA(s), donor DNA, etc.) to the targeted cells and/or a subject. Nonlimiting examples of such recombinant viruses include recombinant adeno-associated virus (AAV), recombinant adenoviruses, recombinant lentiviruses, recombinant retroviruses, recombinant herpes simplex viruses, recombinant poxviruses, phages, etc. The present disclosure provides vectors capable of integration in the host genome, such as retrovirus or lentivirus. See, e.g., Ausubel et al., Current Protocols in Molecular Biology, John Wiley & Sons, New York, 1989; Kay, M. A., et al., 2001 Nat. Medic. 7(1):33-40; and Walther W. and Stein U., 2000 Drugs, 60(2): 249-71, incorporated herein by reference.

The present disclosure also provides for DNA segments encoding the proteins disclosed herein, vectors containing these segments and host cells containing the vectors. The vectors may be used to propagate the segment in an appropriate host cell and/or to allow expression from the segment (i.e., an expression vector). The person of ordinary skill in the art would be aware of the various vectors available for propagation and expression of a cloned DNA sequence. In one embodiment, a DNA segment encoding the present protein(s) is contained in a plasmid vector that allows expression of the protein(s) and subsequent isolation and purification of the protein produced by the recombinant vector. Accordingly, the proteins disclosed herein can be purified following expression from the native transposon, obtained by chemical synthesis, or obtained by recombinant methods.

To construct cells that express the present system, expression vectors for stable or transient expression of the present system may be constructed via conventional methods as described herein and introduced into host cells. For example, nucleic acids encoding the components of the present system may be cloned into a suitable expression vector, such as a plasmid or a viral vector in operable linkage to a suitable promoter. The selection of expression vectors/plasmids/viral vectors should be suitable for integration and replication in eukaryotic cells.

In certain embodiments, vectors of the present disclosure can drive the expression of one or more sequences in mammalian cells using a mammalian expression vector. Examples of mammalian expression vectors include pCDM8 (Seed, Nature (1987) 329:840, incorporated herein by reference) and pMT2PC (Kaufman, et al., EMBO J. (1987) 6:187, incorporated herein by reference). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd eds., Cold Spring Harbor Laboratory, Cold Spring Harbor Laboratory Press, Cold Spring Harbor, N.Y., 1989, incorporated herein by reference.

Vectors of the present disclosure can comprise any of a number of promoters known to the art, wherein the promoter is constitutive, regulatable or inducible, cell type specific, tissue-specific, or species specific. In addition to the sequence sufficient to direct transcription, a promoter sequence of the invention can also include sequences of other regulatory elements that are involved in modulating transcription (e.g., enhancers, kozak sequences and introns). Many promoter/regulatory sequences useful for driving constitutive expression of a gene are available in the art and include, but are not limited to, for example, CMV (cytomegalovirus promoter), EF1a (human elongation factor 1 alpha promoter), SV40 (simian vacuolating virus 40 promoter), PGK (mammalian phosphoglycerate kinase promoter), Ubc (human ubiquitin C promoter), human beta-actin promoter, rodent beta-actin promoter, CBh (chicken beta-actin promoter), CAG (hybrid promoter contains CMV enhancer, chicken beta actin promoter, and rabbit beta-globin splice acceptor), TRE (Tetracycline response element promoter), H1 (human polymerase III RNA promoter), U6 (human U6 small nuclear promoter), and the like. Additional promoters that can be used for expression of the components of the present system, include, without limitation, cytomegalovirus (CMV) intermediate early promoter, a viral LTR such as the Rous sarcoma virus LTR, HIV-LTR, HTLV-1 LTR, Maloney murine leukemia virus (MMLV) LTR, myeoloproliferative sarcoma virus (MPSV) LTR, spleen focus-forming virus (SFFV) LTR, the simian virus 40 (SV40) early promoter, herpes simplex tk virus promoter, elongation factor 1-alpha (EF1-α) promoter with or without the EF1-α intron. Additional promoters include any constitutively active promoter. Alternatively, any regulatable promoter may be used, such that its expression can be modulated within a cell.

Moreover, inducible and tissue specific expression of a RNA, transmembrane proteins, or other proteins can be accomplished by placing the nucleic acid encoding such a molecule under the control of an inducible or tissue specific promoter/regulatory sequence. Examples of tissue specific or inducible promoter/regulatory sequences which are useful for this purpose include, but are not limited to, the rhodopsin promoter, the MMTV LTR inducible promoter, the SV40 late enhancer/promoter, synapsin 1 promoter, ET hepatocyte promoter, GS glutamine synthase promoter and many others. Various commercially available ubiquitous as well as tissue-specific promoters and tumor-specific are available, for example from InvivoGen. In addition, promoters which are well known in the art can be induced in response to inducing agents such as metals, glucocorticoids, tetracycline, hormones, and the like, are also contemplated for use with the invention. Thus, it will be appreciated that the present disclosure includes the use of any promoter/regulatory sequence known in the art that is capable of driving expression of the desired protein operably linked thereto.

The vectors of the present disclosure may direct expression of the nucleic acid in a particular cell type (e.g., tissue-specific regulatory elements are used to express the nucleic acid). Such regulatory elements include promoters that may be tissue specific or cell specific. The term "tissue specific" as it applies to a promoter refers to a promoter that is capable of directing selective expression of a nucleotide sequence of interest to a specific type of tissue (e.g., seeds) in the relative absence of expression of the same nucleotide sequence of interest in a different type of tissue. The term "cell type specific" as applied to a promoter refers to a promoter that is capable of directing selective expression of a nucleotide sequence of interest in a specific type of cell in the relative absence of expression of the same nucleotide sequence of interest in a different type of cell within the same tissue. The term "cell type specific" when applied to a promoter also means a promoter capable of promoting selective expression of a nucleotide sequence of interest in a region within a single tissue. Cell type specificity of a promoter may be assessed using methods well known in the art, e.g., immunohistochemical staining.

Additionally, the vector may contain, for example, some or all of the following: a selectable marker gene, such as the neomycin gene for selection of stable or transient transfectants in host cells; enhancer/promoter sequences from the immediate early gene of human CMV for high levels of transcription; transcription termination and RNA processing signals from SV40 for mRNA stability; 5'- and 3'-untranslated regions for mRNA stability and translation efficiency from highly-expressed genes like α-globin or β-globin; SV40 polyoma origins of replication and ColE1 for proper episomal replication; internal ribosome binding sites (IRESes), versatile multiple cloning sites; T7 and SP6 RNA promoters for in vitro transcription of sense and antisense RNA; a "suicide switch" or "suicide gene" which when triggered causes cells carrying the vector to die (e.g., HSV thymidine kinase, an inducible caspase such as iCasp9), and reporter gene for assessing expression of the chimeric receptor. Suitable vectors and methods for producing vectors containing transgenes are well known and available in the art. Selectable markers also include chloramphenicol resistance, tetracycline resistance, spectinomycin resistance, streptomycin resistance, erythromycin resistance, rifampicin resistance, bleomycin resistance, thermally adapted kanamycin resistance, gentamycin resistance, hygromycin resistance, trimethoprim resistance, dihydrofolate reductase (DHFR), GPT; the URA3, HIS4, LEU2, and TRP1 genes of *S. cerevisiae*.

When introduced into the host cell, the vectors may be maintained as an autonomously replicating sequence or extrachromosomal element or may be integrated into host DNA.

In one embodiment, the donor DNA may be delivered using the same gene transfer system as used to deliver the Cas protein and/or Tns protein (included on the same vector) or may be delivered using a different delivery system. In another embodiment, the donor DNA may be delivered using the same transfer system as used to deliver gRNA(s).

In one embodiment, the present disclosure comprises integration of exogenous DNA into the endogenous gene.

Alternatively, an exogenous DNA is not integrated into the endogenous gene. The DNA may be packaged into an extrachromosomal, or episomal vector (such as AAV vector), which persists in the nucleus in an extrachromosomal state, and offers donor-template delivery and expression without integration into the host genome. Use of extrachromosomal gene vector technologies has been discussed in detail by Wade-Martins R (Methods Mol Biol. 2011; 738: 1-17, incorporated herein by reference).

The present system (e.g., proteins, polynucleotides encoding these proteins, donor polynucleotides and compositions comprising the proteins and/or polynucleotides described herein) may be delivered by any suitable means. In certain embodiments, the system is delivered in vivo. In other embodiments, the system is delivered to isolated/cultured cells (e.g., autologous iPS cells) in vitro to provide modified cells useful for in vivo delivery to patients afflicted with a disease or condition.

Vectors according to the present disclosure can be transformed, transfected or otherwise introduced into a wide variety of host cells. Transfection refers to the taking up of a vector by a host cell whether or not any coding sequences are in fact expressed. Numerous methods of transfection are known to the ordinarily skilled artisan, for example, lipofectamine, calcium phosphate co-precipitation, electroporation, DEAE-dextran treatment, microinjection, viral infection, and other methods known in the art. Transduction refers to entry of a virus into the cell and expression (e.g., transcription and/or translation) of sequences delivered by the viral vector genome. In the case of a recombinant vector, "transduction" generally refers to entry of the recombinant viral vector into the cell and expression of a nucleic acid of interest delivered by the vector genome.

Any of the vectors comprising a nucleic acid sequence that encodes the components of the present system is also within the scope of the present disclosure. Such a vector may be delivered into host cells by a suitable method. Methods of delivering vectors to cells are well known in the art and may include DNA or RNA electroporation, transfection reagents such as liposomes or nanoparticles to delivery DNA or RNA; delivery of DNA, RNA, or protein by mechanical deformation (see, e.g., Sharei et al. Proc. Natl. Acad. Sci. USA (2013) 110(6): 2082-2087, incorporated herein by reference); or viral transduction. In some embodiments, the vectors are delivered to host cells by viral transduction. Nucleic acids can be delivered as part of a larger construct, such as a plasmid or viral vector, or directly, e.g., by electroporation, lipid vesicles, viral transporters, microinjection, and biolistics (high-speed particle bombardment). Similarly, the construct containing the one or more transgenes can be delivered by any method appropriate for introducing nucleic acids into a cell. In some embodiments, the construct or the nucleic acid encoding the components of the present system is a DNA molecule. In some embodiments, the nucleic acid encoding the components of the present system is a DNA vector and may be electroporated to cells. In some embodiments, the nucleic acid encoding the components of the present system is an RNA molecule, which may be electroporated to cells.

Additionally, delivery vehicles such as nanoparticle- and lipid-based mRNA or protein delivery systems can be used. Further examples of delivery vehicles include lentiviral vectors, ribonucleoprotein (RNP) complexes, lipid-based delivery system, gene gun, hydrodynamic, electroporation or nucleofection microinjection, and biolistics. Various gene delivery methods are discussed in detail by Nayerossadat et al. (Adv Biomed Res. 2012; 1: 27) and Ibraheem et al. (Int J Pharm. 2014 Jan. 1; 459(1-2):70-83), incorporated herein by reference.

2. Compositions

The present system and self-transposable nucleic acid sequence may be administered in a pharmaceutically acceptable carrier or excipient as a pharmaceutical composition.

Administration of the present system or compositions can be in one dose, continuously or intermittently throughout the course of treatment. Administration may be through any suitable mode of administration, including but not limited to: intravenous, intra-arterial, intramuscular, intracardiac, intrathecal, subventricular, epidural, intracerebral, intracerebroventricular, sub-retinal, intravitreal, intraarticular, intraocular, intraperitoneal, intrauterine, intradermal, subcutaneous, transdermal, transmucosal, topical, and inhalation.

Methods of determining the most effective means and dosage of administration are known to those of skill in the art and will vary with the composition used for therapy, the purpose of the therapy and the subject being treated. Single or multiple administrations can be carried out with the dose level and pattern being selected by the treating physician.

In some embodiments, the components of the present system or the self-transposable nucleic acid sequence may be mixed with a pharmaceutically acceptable carrier to form pharmaceutical compositions, which are also within the scope of the present disclosure.

To perform the methods described herein, an effective amount of the present system, the self-transposable nucleic acid sequence, or present compositions can be administered to a subject in need of the treatment. As used herein the term "effective amount" may be used interchangeably with the term "therapeutically effective amount" and refers to that quantity of an agent, cell population, or pharmaceutical composition (e.g., a composition comprising agents and/or hematopoietic cells) that is sufficient to result in a desired activity upon administration to a subject in need thereof. Within the context of the present disclosure, the term "effective amount" refers to that quantity of a compound, cell population, or pharmaceutical composition that is sufficient to delay the manifestation, arrest the progression, relieve or alleviate at least one symptom of a disorder treated by the methods of the present disclosure. Note that when a combination of active ingredients is administered the effective amount of the combination may or may not include amounts of each ingredient that would have been effective if administered individually.

Effective amounts vary, as recognized by those skilled in the art, depending on the particular condition being treated, the severity of the condition, the individual patient parameters including age, physical condition, size, gender and weight, the duration of the treatment, the nature of concurrent therapy (if any), the specific route of administration and like factors within the knowledge and expertise of the health practitioner. In some embodiments, the effective amount alleviates, relieves, ameliorates, improves, reduces the symptoms, or delays the progression of any disease or disorder in the subject. In some embodiments, the subject is a human. In some embodiments, the subject is a human patient having a hematopoietic malignancy.

In the context of the present disclosure insofar as it relates to any of the disease conditions recited herein, the terms "treat," "treatment," and the like mean to relieve or alleviate at least one symptom associated with such condition, or to slow or reverse the progression of such condition. Within the meaning of the present disclosure, the term "treat" also denotes to arrest, delay the onset (i.e., the period prior to clinical manifestation of a disease) and/or reduce the risk of developing or worsening a disease. For example, in connection with cancer the term "treat" may mean eliminate or reduce a patient's tumor burden, or prevent, delay or inhibit metastasis, etc.

The phrase "pharmaceutically acceptable," as used in connection with compositions and/or cells of the present disclosure, refers to molecular entities and other ingredients of such compositions that are physiologically tolerable and do not typically produce untoward reactions when administered to a subject (e.g., a mammal, a human). Preferably, as used herein, the term "pharmaceutically acceptable" means approved by a regulatory agency of the Federal or a state government or listed in the U.S. Pharmacopeia or other generally recognized pharmacopeia for use in mammals, and more particularly in humans. "Acceptable" means that the carrier is compatible with the active ingredient of the composition (e.g., the nucleic acids, vectors, cells, or therapeutic antibodies) and does not negatively affect the subject to which the composition(s) are administered. Any of the pharmaceutical compositions and/or cells to be used in the present methods can comprise pharmaceutically acceptable carriers, excipients, or stabilizers in the form of lyophilized formations or aqueous solutions.

Pharmaceutically acceptable carriers, including buffers, are well known in the art, and may comprise phosphate, citrate, and other organic acids; antioxidants including ascorbic acid and methionine; preservatives; low molecular weight polypeptides; proteins, such as serum albumin, gelatin, or immunoglobulins; amino acids; hydrophobic polymers; monosaccharides; disaccharides; and other carbohydrates; metal complexes; and/or non-ionic surfactants. See, e.g. Remington: The *Science* and Practice of Pharmacy 20th Ed. (2000) Lippincott Williams and Wilkins, Ed. K. E. Hoover.

3. Applications a. Genetic Analysis

The present systems and methods may be used for genetic analysis. Genetic analysis includes, but is not limited to: assessment of the phenotype of a null allele (not expressing functional protein due to interruption of the gene by the transposable segment); assessment of the consequences of insertion of particular active DNA structures or sequences for genetic properties of chromosomes or their parts, such as but not limited to accessibility to Dnase I or to footprinting reagents, or expression or silencing of nearby transcribable genes, or for activity of genetic or epigenetic processes such as, but not limited to homologous recombination, chemical mutagenesis, oxidative DNA damages, DNA methylation, insertion of proviruses or retroposons; assessment of protein domain structure via creation of multiple interruption points within a gene for a multidomain protein, wherein a gene product missing one or more domains of the multidomain protein might exhibit partial activity or activities, including antigenic activities or immunodominant epitopes; assessment of expression pattern via creation of transcriptional fusions of a promoter in the target to a reporter (e.g. beta galactosidase or green fluorescent protein or chloramphenicol transacetylase or luciferase) within the transposable segment; assessment of expression pattern via creation of translational fusions of a portion of a gene product encoded by a target to a gene product or an antigenic peptide encoded by the transposable segment (e.g. beta galactosidase or an epitope tag or an affinity tag); assessment of operon structure, in which interruption of transcription by insertion upstream of a gene results in altered expression of a gene without disrupting the coding sequence of that gene; gratuitous expression of a gene, in which transcription from a promoter within the transposable segment results in expression of a gene downstream of the position of insertion of the transposable segment, with or without regulation of transcription of the promoter within the transposable segment; gratuitous expression of a protein fusion, in which transcription from a promoter within the transposable segment results in translation of a protein beginning within the transposable segment and proceeding toward the outside of the transposon, then continuing into the gene within which the transposable segment is inserted, resulting in a fusion of the transposon-encoded protein with the target protein; assessment of the consequences of introducing into the host cell any transcript or gene product entirely encoded within the transposable segment, especially where it is desirable to assess position-effects (the consequences not only of expression but of expression in different positions within the genome).

The present systems and methods may be used for targeted DNA enrichment, where user-defined genetic payloads are directed to integrate at user-defined sites within DNA. This method may be applied to various application areas, such as for clinically important workflows. These include, but are not limited to, whole exome sequencing (WES; see Suwinski et al., Front. Genet. 10, 49 (2019); Warr et al., G3 (Bethesda) 5, 1543-1550 (2015)); deep sequencing of patient adaptive immune repertoires, specifically, T-cell receptor and immunoglobulin diversification (see Friedensohn et al., Trends Biotechnol 35, 203-214 (2017) and Rosati et al., BMC Biotechnol. 17, 61 (2017), incorporated herein by reference); and targeted enrichment and deep sequencing of cancer biomarkers in the context of oncology (Kamps et al., Int J Mol Sci 18, (2017), incorporated herein by reference).

In one embodiment, the present systems may be used for flanking a nucleic acid sequence of interest (NASI). The NASI may have a first flanking sequence on one side of the NASI and a second flanking sequence on the other side. The method comprises a transposon-encoded CRISPR-Cas system, as described herein, comprising a first guide RNA specific for the first flanking region, and a second guide RNA specific for the second flanking region. Thus, the CRISPR-Cas system integrates the left transposon end into the first flanking region and the right transposon end into the second flanking region.

In another embodiment, the present system and method is used for targeted DNA enrichment by conducting biochemical RNA-guided DNA integration in vitro (e.g., with purified protein/RNA components and input DNA). The targeted DNA enrichment may include contacting the sample with a first primer specific for the left transposon end sequence, a second primer specific for the right transposon end sequence, and polymerases under conditions for amplification. Following amplification, the NASI can be sequenced, as described above, with next-generation sequencing (NGS) or whole exome sequencing (WES).

All of the necessary or sufficient molecular components of the CRISPR-Tn7 system are expressed recombinantly and purified, which in the case of the CRISPR-Tn7 system from *Vibrio cholerae*, includes Vch TnsA, TnsB, TnsC, TniQ, gRNA Cas7, Cas6, and a natural fusion of Cas8 and Cas5 polypeptides. The gRNA may comprise a single gRNA, but in most embodiments, comprises a library of gRNAs that are designed to target complementary DNA sequences of interest (e.g., the 32-bp protospacer, flanked by a protospacer adjacent motif, or PAM), such that RNA-guided DNA integration occurs proximal to a DNA sequence of interest for downstream enrichment.

The protein and gRNA components are combined with engineered transposon Left ("L") and Right ("R") end sequences, which may be present as a single linear double-stranded DNA (dsDNA) flanking an internal genetic payload, or as two separate DNA molecules, each one of which comprises a dsDNA L or R end; the transposon ends may also be covalently attached to a genetic payload. The genetic payload may be a short adaptor, such as a sequence used for downstream primer binding during a PCR amplification step, as would be performed for NGS library preps for massively parallel DNA sequencing, such as with the Illumina, Pacbio, Ion Torrent, or Nanopore, platforms. The transposon end sequences themselves may also serve as the primer binding sites for downstream NGS library preparation. The engineered transposon Left ("L") and Right ("R") end sequences may comprise a UMI (unique molecular identifier) sequence. Unique molecular identifiers (UMIs), or molecular barcodes (MBC) are short sequences or molecular "tags" added to DNA fragments, commonly used for some next generation sequencing library preparation protocols to identify the input DNA molecule. The protein and RNA molecular components, together with the transposon end sequences which are sometimes linked to a user-defined genetic payload, or adaptor, are then combined with input DNA containing the sequence(s) of interest to be enriched. The DNA may be purified genomic DNA, genomic DNA within a cellular lysate or other cellular extracts, mixtures of DNA from metagenomic samples, DNA from viruses, DNA from bacterial, archaeal, and/or eukaryotic cells, or other types of DNA samples.

b. Genetic Modification

Also provided herein are methods of producing a nucleic acid molecule or cell that is modified by the present system. The method may involve providing a cell and introducing into the cell components of the present system for genome editing. In some embodiments, a nucleic acid that comprises a gRNA that hybridizes to a target site is introduced into the cell. In some embodiments, the gRNA is introduced into the cell on a vector. In some embodiments a Cas protein and/or a Tns protein is introduced into the cell. In some embodiments, a Cas protein and/or a Tns protein is introduced into the cell as a nucleic acid encoding the protein. In some embodiments, the gRNA and a nucleotide sequence encoding one or more Cas proteins and/or Tns proteins are introduced into the cell on the same nucleic acid (e.g., the same vector). In some embodiments, the gRNA and a nucleotide sequence encoding one or more Cas proteins and/or Tns proteins are introduced into the cell on different nucleic acids (e.g., different vectors). In some embodiments, a Cas protein and/or a Tns protein is introduced into the cell in the form of a protein. In some embodiments, a Cas protein endonuclease and the gRNA are pre-formed in vitro and are introduced to the cell in as a complex.

The present disclosure provides for a modified cell produced by the present system and method, an organism (e.g., an animal, a plant, etc.) comprising the cell, a population of cells comprising the cell, tissues of an organism (e.g., an animal, a plant, etc.) comprising the cell, and at least one organ of an organism (e.g., an animal, a plant, etc.) comprising the cell. The present disclosure further encompasses the progeny, clones, cell lines or cells of the genetically modified organism (e.g., an animal, a plant, etc.).

The present disclosure provides a genetically modified organism (e.g., an animal, a plant, etc.). The genetically modified organism (e.g., an animal, a plant, etc.) may be homozygous or heterozygous for the genetic modification.

The present system and method may be used to generate an animal model of the desired disease, disorder, or condition for experimental and screening assays.

The present disclosure further provides progeny of a genetically modified cell, where the progeny can comprise the same genetic modification as the genetically modified cell from which it was derived. The present disclosure further provides a composition comprising a genetically modified cell.

In some embodiments, a genetically modified host cell can generate a genetically modified organism. For example, the genetically modified host cell is a pluripotent stem cell, it can generate a genetically modified organism. Methods of producing genetically modified organisms are known in the art.

Genetic modification may be assessed using techniques that include, for example, Northern blot analysis of tissue samples obtained from the animal, in situ hybridization analysis, Western analysis, immunoassays such as enzyme-linked immunosorbent assays, and reverse-transcriptase PCR (RT-PCR). The site of integration may be determined by Sanger sequencing. For example, DNA is amplified from the analytical PCR reactions and is separated by gel electrophoresis. DNA is then isolated by gel extraction, and samples are analyzed. The site of integration may be determined by next-generation sequencing (NGS).

The advantage of CRISPR as a gene-editing technology, related to previous protein-based technologies (e.g. ZFNs and TALENs), is that the reliance on gRNAs means that specificity may be easily altered, and libraries of gRNAs can be straightforwardly cloned, targeting tens of thousands of sites simultaneously.

gRNA libraries may be harnessed for the following two approaches. In the first, libraries of gRNAs across a population could be used to target the present transposons to a plurality of unique sites (e.g., hundreds to tens of thousands of unique sites), in a single heterogeneous cell population, either for screening purposes or cell engineering purposes. This can have utility in bacteria, and eukaryotic cells.

Secondly, gRNA libraries may be introduced within single, engineered CRISPR arrays, so that a single CRISPR-containing transposon has a suite of gRNAs that can mobilize the system into any number of DNA target sites, anytime those sites are encountered within the cellular environment. A single autonomous CRISPR-containing transposon may be programmed with a large library of gRNAs simultaneously, for multiplexed RNA-guided DNA integration.

The present transposon may be simultaneously integrated into multiple genomic sites, within individual bacterial clones.

The present methods and systems for RNA-guided DNA integration, in some embodiments, deliver cargo genes, with or without scars left behind from the transposon end sequences that are required for specific excision and integration by the TnsA and TnsB machinery. These end sequences may have different sequence specificity. One or more base-pairs may be mutated without a drop in integration efficiency. The present methods and systems may permit integration with the smallest scars possible, and/or with integration allow for protein coding sequences to extend through the transposon end sequence.

The present methods and systems may be used to specifically tag the N- or C-termini of a gene of interest (or tag it internally), whereby the end sequence being integrated would encode a linker-like amino acid sequence that would bridge the native protein with the cargo encoded within the transposon donor, such as an epitope tag, a fluorescent reporter protein, etc.

There are currently limitations with the use of programmable nucleases for insertion of large cargos in a cell. The present system and methods allow for the insertion of large donor DNA cargos. The donor DNA cargo may be at least or about 2 kb, at least or about 10 kb, at least or about 50 kb, at least or about 100 kb, between 20 kb and 60 kb, or between 20 kb and 100 kb in length.

The large donor DNA cargo may be inserted into any cell, eukaryotic or prokaryotic. In some embodiments, the large donor DNA is inserted into bacterial cells. The bacterial cells may be *E. coli* cells. The bacterial cells may be cultured under conditions at least 5 degrees Celsius below optimal growth temperature for said bacterial cells. The temperature for culturing may be less than 37 degrees Celsius, including, for example, about 32 degrees Celsius, about 30 degrees Celsius, about 28 degrees Celsius, about 26 degrees Celsius, about 24 degrees Celsius, about 22 degrees Celsius, about 20 degrees Celsius, between 20 and 32 degrees Celsius, between 25 and 30 degrees Celsius, or between 28 and 32 degrees Celsius.

a. Plant

Genetic modification of plants is a powerful tool to meet the growing demand for food. Genetically modified plants can potentially have improved crop yields, enhanced nutritional value, and increased shelf life. They can also be resistant to unfavorable environmental conditions, insects, and pesticides. See, for example, Genetic engineering for improving quality and productivity of crops, Agriculture & Food Security, 2013, 2:15, incorporated herein by reference. The first genetically modified plant approved by the U.S. Department of Agriculture for commercial production was the FLAVR SAVR tomato in 1992. The FLAVR SAVR tomato was modified to increase the firmness of the tomato in order to extend shelf life.

Systems that have been used to genetically modify plants include zinc-finger nucleases (ZFNs), TALENs (transcription activator-like effector nucleases), oligonucleotide-directed mutagenesis (ODM), and CRISPR-Cas. See, for example, Shah T, Andleeb T, et al. Plant Physiology and Biochemistry, 2018, 131: 12-21, incorporated herein by reference. Distinct from animal, yeast, or bacterial cells to which recombinant molecules (DNA, RNA or protein) could be directly transformed for genome editing, recombinant plasmid DNA is typically delivered into plant cells via the *Agrobacterium*-mediate transformation, biolistic bombardment, or protoplast transformation due to the presence of cell wall. In addition, in contrast to microbial and mammalian systems in which gene targeting is an established tool, it is extremely inefficient and difficult to achieve successful gene targeting in plants, largely due to the low frequency of homologous recombination. Therefore, it is imperative to develop new technologies for more efficient and specific gene targeting and genome editing in plants.

The present systems and methods have broad applications in gene discovery and validation, mutational and cisgenic breeding, and hybrid breeding. These applications should facilitate the production of a new generation of genetically modified crops with various improved agronomic traits such as herbicide resistance, herbicide tolerance, drought tolerance, male sterility, insect resistance, abiotic stress tolerance, modified fatty acid metabolism, modified carbohydrate metabolism, modified seed yield, modified oil percent, modified protein percent, resistance to bacterial disease, disease (e.g. bacterial, fungal, and viral) resistance, high yield, and superior quality. These applications may also facilitation the production of a new generation of genetically modified crops with optimized fragrance, nutritional value, shelf-life, pigmentations (e.g., lycopene content), starch content (e.g., low-gluten wheat), toxin levels, propagation and/or breeding and growth time. See, for example, CRISPR/Cas Genome Editing and Precision Plant Breeding in Agriculture (Annual Rev of Plant Biology, 2019), incorporated herein by reference.

The present disclosure provides for an engineered transposon-encoded CRISPR-Cas system and methods for RNA-guided DNA integration in a plant cell, comprising: (i) at least one Cas protein, (ii) a guide RNA (gRNA), and (iii) an engineered transposon system.

The present disclosure provides for an engineered transposon-encoded CRISPR-Cas system and methods for RNA-guided DNA integration in a plant cell, comprising: (i) at least one Cas protein, (ii) a guide RNA (gRNA), and (iii) a Tn7-like transposon system.

Also encompassed by the present disclosure is a system and methods for RNA-guided DNA integration in a plant cell, comprising: (i) one or more vectors encoding an engineered CRISPR-Cas system, wherein the CRISPR-Cas system comprises: (a) at least one Cas protein, and (b) a guide RNA (gRNA); and (ii) one or more vectors encoding a Tn7-like transposon system, wherein the CRISPR-Cas system and the transposon system are on same or different vector(s).

The present disclosure also provides for a system and methods for RNA-guided DNA integration in a plant cell, comprising: (i) one or more vectors encoding an engineered CRISPR-Cas system, wherein the CRISPR-Cas system comprises: (a) at least one Cas protein, and (b) a guide RNA (gRNA); and (ii) one or more vectors encoding an engineered transposon system, wherein the CRISPR-Cas system and the transposon system are on same or different vector(s).

The present disclosure provides for a method for RNA-guided DNA integration in a plant cell, the method comprising introducing into the plant cell an engineered transposon-encoded CRISPR-Cas system, wherein the transposon-encoded CRISPR-Cas system comprises: (i) at least one Cas protein, (ii) a guide RNA (gRNA) specific for a target site, (iii) an engineered transposon system, and (iv) a donor DNA, wherein the transposon-encoded CRISPR-Cas system integrates the donor DNA proximal to the target site.

The system and methods may further comprise a donor DNA. The donor DNA comprises a cargo nucleic acid and transposon end sequences. The transposon-encoded CRISPR-Cas system may integrate the donor DNA into the genome of the plant cell.

The cargo nucleic acid may be flanked by transposon end sequences. The integration may be about 46-bp to 55-bp downstream of the target site. The integration may be about 47-bp to 51-bp downstream of the target site.

The target site may be flanked by a protospacer adjacent motif (PAM). The transposon system may be a bacterial Tn7-like transposon system. Tn7 transposes via a cut-and-paste mechanism, Class II. Choi et al. PNAS 110(22): E2038-E2045 (2013); Ivics et al. Nature Methods 6(6): 415-422 (2009). The transposon system may be derived from *Vibrio cholerae, Photobacterium iliopiscarium, Pseudoalteromonas* sp. P1-25, *Pseudoalteromonas ruthenica, Photobacterium ganghwense, Shewanella* sp. UCD-KL21, *Vibrio diazotrophicus, Vibrio* sp. 16, *Vibrio* sp. F12, *Vibrio splendidus, Aliivibrio wodanis*, and *Parashewanella spongiae*. The engineered transposon-encoded CRISPR-Cas system may be from a bacteria selected from the group consisting of: *Vibrio cholerae* strain 4874, *Photobacterium iliopiscarium* strain NCIMB, *Pseudoalteromonas* sp. P1-25, *Pseudoalteromonas ruthenica* strain S3245, *Photobacterium ganghwense* strain JCM, *Shewanella* sp. UCD-KL21, *Vibrio cholerae* strain OYP7GO4, *Vibrio cholerae* strain M1517, *Vibrio diazotrophicus* strain 60.6 F, *Vibrio* sp. 16, *Vibrio* sp. F12, *Vibrio splendidus* strain UCD-SED10, *Aliivibrio wodanis* 06/09/160, and *Parashewanella spongiae* strain HJ039.

In one embodiment, transposon system is derived from *Vibrio cholerae* Tn6677. The system can encompass gain-of-function Tn7 mutants (Lu et al. EMBO 19(13):3446-3457 (2000); U.S. Patent Publication No. 20020188105) as well as replicative Tn7 transposition mutants (May et al. *Science* 272: 401-404 (1996)).

The transposon system may comprise TnsD or TniQ. The present system may comprise TnsA, TnsB and TnsC. The present system may comprise TnsB and TnsC.

The system may be derived from a Class 1 CRISPR-Cas system. The present system may be derived from a Class 2 CRISPR-Cas system. The present system may be derived from a Type I CRISPR-Cas system. The present system may be derived from a Type V CRISPR-Cas system.

The present system may be nuclease-deficient. The present system may comprise Cas6, Cas7 and Cas8/Cas5 fusion. The present system may comprise Cas6, Cas7, Cas8, and Cas5. The system may comprise a Cascade complex. The present system may comprise C2c5 (Cas12k).

Non-limiting examples of plants that may be genetically modified using the present systems and methods include: grains, forage crops, fruits, vegetables, oil seed crops, palms, forestry, vines, maize (corn, *Zea mays*), banana, peanut, field peas, sunflower, tomato, canola, tobacco, wheat, barley, oats, potato, soybeans, cotton, carnations, sorghum, lupin, rice, *Arabidopsis thaliana, Medicago truncatula, Solanum lycopersicum, Glycine max, Brachypodium distachyon, Oryza sativa, Sorghum bicolor*, and *Solanum tuberosum*. In some embodiments, the plant is a *petunia*, of the genus *Atropa*, rutabaga, celery, switchgrass, apple, *Nicotiana benthamiana*, or *Setaria viridis*.

The present systems and methods may be used to modify monocot plants, including rice, a model plant and crop species. The present systems and methods may be used to modify dicot plants, including for example soybean (*Glycine max*), potato (*Solanum*), and *Arabidopsis thaliana*.

The present systems and methods can be used to transform a number of monocotyledonous and dicotyledonous plants and plant cell systems, including dicots such as safflower, alfalfa, soybean, coffee, amaranth, rapeseed (high erucic acid and canola), peanut or sunflower, as well as monocots such as oil palm, sugarcane, banana, sudangrass, corn, wheat, rye, barley, oat, rice, millet, or sorghum. Also suitable are gymnosperms such as fir and pine.

Thus, the methods described herein can be utilized with dicotyledonous plants belonging, for example, to the orders Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales. The methods described herein also can be utilized with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales, or with plants belonging to Gymnospermae, e.g., Pinales, Ginkgoales, Cycadales and Gnetales.

The methods can be used over a broad range of plant species, including species from the dicot genera *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Escholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis*, and *Vigna*: the monocot genera *Allium, Andropogon, Aragrostis, Asparagus, Avena, Cynodon, Elaeis, Festuca, Festulolium, Heterocallis, Hordeum, Lemna, Lolium, Musa, Oryza, Panicum, Pannesetum, Phleum, Poa, Secale, Sorghum, Triticum*, and *Zea*; or the gymnosperm genera *Abies, Cunninghamia, Picea, Pinus*, and *Pseudotsuga*.

Target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., *petunia*, rose, *chrysanthemum*), conifers and pine trees (e.g., pine fir, spruce); plants used in phytoremediation (e.g., heavy metal accumulating plants); oil crops (e.g., sunflower, rapeseed) and plants used for experimental purposes (e.g., *Arabidopsis*). Thus, the disclosed methods and compositions have use over a broad range of plants, including, but not limited to, species from the genera *Asparagus, Avena, Brassica, Citrus, Citrullus, Capsicum, Cucurbita, Daucus, Glycine, Hordeum, Lactuca, Lycopersicon, Malus, Manihot, Nicotiana, Oryza, Persea, Pisum, Pyrus, Prunus, Raphanus, Secale, Solanum, Sorghum, Triticum, Vitis, Vigna*, and *Zea*. One of skill in the art will recognize that after the expression cassette is stably incorporated in transgenic plants and confirmed to be operable, it can be introduced into other plants by sexual crossing. Any of a number of standard breeding techniques can be used, depending upon the species to be crossed.

The plant cell may be a cell of rice, soybean, maize, tomato, banana, peanut, field pea, sunflower, canola, tobacco, wheat, barley, oats, potato, cotton, carnation, sorghum, or lupin. The plant cell may be a cell of *Solanum lycopersicum, Glycine max, Arabidopsis thaliana, Medicago truncatula, Brachypodium distachyon, Oryza sativa, Sorghum bicolor, Zea mays*, or *Solanum tuberosum, petunia*, the genus *Atropa*, rutabaga, celery, switchgrass, apple, *Nicotiana benthamiana*, or *Setaria viridis*.

The plant cell may be a cell of a monocot plant, or a dicot plant.

The present system and method may confer one or more of the following traits to the plant cell: herbicide tolerance, drought tolerance, male sterility, insect resistance, abiotic stress tolerance, modified fatty acid metabolism, modified carbohydrate metabolism, modified seed yield, modified oil percent, modified protein percent, resistance to bacterial disease, resistance to fungal disease, and resistance to viral disease.

The present disclosure provides for a modified plant cell produced by the present system and method, a plant comprising the plant cell, and a seed, fruit, plant part, or propagation material of the plant. The present disclosure further encompasses the progeny, clones, cell lines or cells of the transgenic plants.

The present disclosure provides a transgenic plant. The transgenic plant may be homozygous or heterozygous for the genetic modification.

Also provided by the present disclosure are transformed or genetically modified plant cells, tissues, plants and products that contain the transformed or genetically modified plant cells.

In one embodiment, the transformed or genetically modified cells, and tissues and products comprise a nucleic acid integrated into the genome, and production by plant cells of a gene product due to the transformation or genetic modification.

Transformed or genetically modified plant cells of the present disclosure may be as populations of cells, or as a tissue, seed, whole plant, stem, fruit, leaf, root, flower, stem, tuber, grain, animal feed, a field of plants, and the like.

Methods of introducing exogenous nucleic acids into plant cells are well known in the art. Such plant cells are considered "transformed". DNA constructs can be introduced into plant cells by various methods, including, but not limited to PEG- or electroporation-mediated protoplast transformation, tissue culture or plant tissue transformation by biolistic bombardment, or the *Agrobacterium*-mediated transient and stable transformation. In one embodiment, rice protoplasts can be efficiently transformed with a plasmid construct. The transformation can be transient or stable transformation. Suitable methods also include viral infection (such as double stranded DNA viruses), transfection, conjugation, protoplast fusion, electroporation, particle gun technology, calcium phosphate precipitation, direct microinjection, silicon carbide whiskers technology, *Agrobacterium*-mediated transformation and the like. The choice of method is generally dependent on the type of cell being transformed and the circumstances under which the transformation is taking place (i.e., in vitro, ex vivo, or in vivo). Transformation methods based upon the soil bacterium *Agrobacterium tumefaciens* are useful for introducing an exogenous nucleic acid molecule into a vascular plant. The wild type form of *Agrobacterium* contains a Ti (tumor-inducing) plasmid that directs production of tumorigenic crown gall growth on host plants. Transfer of the tumor-inducing T-DNA region of the Ti plasmid to a plant genome requires the Ti plasmid-encoded virulence genes as well as T-DNA borders, which are a set of direct DNA repeats that delineate the region to be transferred. An *Agrobacterium*-based vector is a modified form of a Ti plasmid, in which the tumor inducing functions are replaced by the nucleic acid sequence of interest to be introduced into the plant host.

*Agrobacterium*-mediated transformation generally employs cointegrate vectors or binary vector systems, in which the components of the Ti plasmid are divided between a helper vector, which resides permanently in the *Agrobacterium* host and carries the virulence genes, and a shuttle vector, which contains the gene of interest bounded by T-DNA sequences. A variety of binary vectors are well known in the art and are commercially available, for example, from Clontech (Palo Alto, Calif.). Methods of coculturing *Agrobacterium* with cultured plant cells or wounded tissue such as leaf tissue, root explants, hypocotyledons, stem pieces or tubers, for example, also are well known in the art. See., e.g., Glick and Thompson, (eds.), Methods in Plant Molecular Biology and Biotechnology, Boca Raton, Fla.: CRC Press (1993), incorporated herein by reference. In one embodiment, the transposon-encoded CRISPR-Cas system is introduced into the plant cell via *Agrobacterium*-mediated transformation of the plant cell.

Microprojectile-mediated transformation also can be used to produce a transgenic plant. This method, first described by Klein et al. (Nature 327:70-73 (1987), incorporated herein by reference), relies on microprojectiles such as gold or tungsten that are coated with the desired nucleic acid molecule by precipitation with calcium chloride, spermidine or polyethylene glycol. The microprojectile particles are accelerated at high speed into an angiosperm tissue using a device such as the BIOLISTIC PD-1000 (Biorad; Hercules Calif.).

A nucleic acid may be introduced into a plant in a manner such that the nucleic acid is able to enter a plant cell(s), e.g., via an in vivo or ex vivo protocol. By "in vivo," it is meant that the nucleic acid is administered to a living body of a plant. By "ex vivo" it is meant that cells or explants are modified outside of the plant, and then such cells or organs are regenerated to a plant. A number of vectors suitable for stable transformation of plant cells or for the establishment of transgenic plants have been described, including those described in Weissbach and Weissbach, (1989) Methods for Plant Molecular Biology Academic Press, and Gelvin et al., (1990) Plant Molecular Biology Manual, Kluwer Academic Publishers, incorporated herein by reference. Specific examples include those derived from a Ti plasmid of *Agrobacterium tumefaciens*, as well as those disclosed by Herrera-Estrella et al. (1983) Nature 303: 209, Bevan (1984) Nucl Acid Res. 12: 8711-8721, Klee (1985) Bio/Technolo 3: 637-642, incorporated herein by reference. Alternatively, non-Ti vectors can be used to transfer the DNA into plants and cells by using free DNA delivery techniques. By using these methods transgenic plants such as wheat, rice (Christou (1991) Bio/Technology 9:957-9 and 4462, incorporated herein by reference) and corn (Gordon-Kamm (1990) Plant Cell 2: 603-618, incorporated herein by reference) can be produced. An immature embryo can also be a good target tissue for monocots for direct DNA delivery techniques by using the particle gun (Weeks et al. (1993) Plant Physiol 102: 1077-1084; Vasil (1993) Bio/Technolo 10: 667-674; Wan and Lemeaux (1994) Plant Physiol 104: 37-48 and for *Agrobacterium*-mediated DNA transfer (Ishida et al. (1996) Nature Biotech 14: 745-750), all incorporated herein by reference. Exemplary methods for introduction of DNA into chloroplasts are biolistic bombardment, polyethylene glycol transformation of protoplasts, and microinjection (Daniell et al. Nat. Biotechnol 16:345-348, 1998; Staub et al. Nat. Biotechnol 18: 333-338, 2000; O'Neill et al. Plant J. 3:729-738, 1993; Knoblauch et al. Nat. Biotechnol 17: 906-909; U.S. Pat. Nos. 5,451,513, 5,545,817, 5,545,818, and 5,576,198; in Intl. Application No. WO 95/16783; and in Boynton et al., Methods in Enzymology 217: 510-536 (1993), Svab et al., Proc. Natl. Acad. Sci. USA 90: 913-917 (1993), and McBride et al., Proc. Nati. Acad. Sci. USA 91: 7301-7305 (1994), incorporated herein by reference). Any vector suitable for the methods of biolistic bombardment, polyethylene glycol transformation of protoplasts and microinjection will be suitable as a targeting vector for chloroplast transformation. Any double stranded DNA vector may be used as a transformation vector, especially when the method of introduction does not utilize *Agrobacterium*.

The present system and method may be used to modify a plant stem cell. The term "stem cell" is used herein to refer to a cell (e.g., plant stem cell) that has the ability both to self-renew and to generate a differentiated cell type (see Morrison et al. (1997) Cell 88:287-298, incorporated herein by reference). Stem cells may be characterized by both the presence of specific markers (e.g., proteins, RNAs, etc.) and the absence of specific markers. Stem cells may also be identified by functional assays both in vitro and in vivo, particularly assays relating to the ability of stem cells to give rise to multiple differentiated progeny. Stem cells of interest include pluripotent stem cells (PSCs). The term "pluripotent stem cell" or "PSC" is used herein to mean a stem cell capable of producing all cell types of the organism. Pluripotent stem cells of plants are capable of giving rise to all cell types of the plant (e.g., cells of the root, stem, leaves, etc.).

The present disclosure further provides progeny of a genetically modified cell, where the progeny can comprise the same genetic modification as the genetically modified cell from which it was derived. The present disclosure further provides a composition comprising a genetically modified cell.

In some embodiments, a genetically modified host cell can generate a genetically modified organism. For example, the genetically modified host cell is a pluripotent stem cell (i.e., PSC such as a pluripotent plant stem cell, etc.), it can generate a genetically modified organism. Methods of producing genetically modified organisms are known in the art. For example, see Husaini et al., GM Crops. 2011, 2(3):150-62, incorporated herein by reference.

The present systems and methods may be used for specific gene targeting and precise genome editing in plant and crop species. In one embodiment, the present systems and methods are adapted to use in plants. In one embodiment, a series of plant-specific RNA-guided Genome Editing vectors (pRGE plasmids) are provided for expression of the present system in plants. The plasmids may be optimized for transient expression of the present system in plant protoplasts, or for stable integration and expression in intact plants via the *Agrobacterium*-mediated transformation. In one aspect, the plasmid vector constructs include a nucleotide sequence comprising a DNA-dependent RNA polymerase III promoter, wherein said promoter operably linked to a gRNA molecule and a Pol III terminator sequence, wherein said gRNA molecule includes a DNA target sequence; and a nucleotide sequence comprising a DNA-dependent RNA polymerase II promoter operably linked to a nucleic acid sequence encoding a nuclease.

In certain embodiments, the present systems and methods use a monocot promoter to drive the expression of one or more components of the present systems (e.g., gRNA) in a monocot plant. In certain embodiments, the present systems and methods use a dicot promoter to drive the expression of one or more components of the present systems (e.g., gRNA) in a dicot plant. In one embodiment, the promoter is a rice UBI10 promoter (OsUBI10 promoter). See U.S. Patent Publication No. 20150067922, incorporated herein by reference.

In one embodiment, the present system is transiently expressed in plant protoplasts. Vectors for transient transformation of plants include, but are not limited to, pRGE3, pRGE6, pRGE31, and pRGE32. In one embodiment, the vector may be optimized for use in a particular plant type or species, such as pStGE3.

In one embodiment, the present system may be stably integrated into the plant genome, for example via *Agrobacterium*-mediated transformation. Thereafter, one or more components of the present system (e.g., the transgene) may be removed by genetic cross and segregation, which may lead to the production of non-transgenic, but genetically modified plants or crops. In one embodiment, the vector is optimized for *Agrobacterium*-mediated transformation. In one embodiment, the vector for stable integration is pRGEB3, pRGEB6, pRGEB31, pRGEB32, or pStGEB3.

In one aspect, gene editing may be obtained using the present systems and methods via deletion or insertion. In another aspect, a donor DNA fragment with positive (e.g., herbicide or antibiotic resistance) and/or negative (e.g., toxin genes) selection markers could be co-introduced with the present system into plant cells for targeted gene repair/correction and knock-in (gene insertion and replacement). In combination with different donor DNA fragments, the present system can be used to modify various agronomic traits for genetic improvement.

Nucleic acids introduced into a plant cell can be used to confer desired traits on essentially any plant. The present systems and methods can produce genetically engineered plants. A gRNA can be designed to specifically target any plant genes or DNA sequences. The ability to efficiently and specifically create targeted mutations in the plant genome greatly facilitates the development of many new crop cultivars with improved or novel agronomic traits. These include, but not limited to, disease resistant crops by targeted mutation of disease susceptibility genes or genes encoding negative regulators (e.g., Mlo gene) of plant defense genes, drought and salt tolerant crops by targeted mutation of genes encoding negative regulators of abiotic stress tolerance, low amylose grains by targeted mutation of Waxy gene, rice or other grains with reduced rancidity by targeted mutation of major lipase genes in aleurone layer, etc.

As used herein, genetically modified plants include a plant into which has been introduced an exogenous polynucleotide. Genetically modified plants also include a plant that has been genetically manipulated such that endogenous nucleotides have been altered to include a mutation, such as a deletion, an insertion, a transition, a transversion, or a combination thereof. For instance, an endogenous coding region could be deleted. Such mutations may result in a polypeptide having a different amino acid sequence than was encoded by the endogenous polynucleotide. Another example of a genetically modified plant is one having an altered regulatory sequence, such as a promoter, to result in increased or decreased expression of an operably linked endogenous coding region.

The present disclosure provides for systems and methods for transient expression or stable integration of the transgenes encoding one or more components of the present system for plants.

DNA constructs may be introduced into the genome of a desired plant host by a variety of conventional techniques. For reviews of such techniques see, for example, Weissbach & Weissbach Methods for Plant Molecular Biology (1988, Academic Press, N.Y.) Section VIII, pp. 421-463; and Grierson & Corey, Plant Molecular Biology (1988, 2d Ed.), Blackie, London, Ch. 7-9, incorporated herein by reference. For example, the DNA construct may be introduced directly into the genomic DNA of the plant cell using techniques such as electroporation and microinjection of plant cell protoplasts, or the DNA constructs can be introduced directly to plant tissue using biolistic methods, such as DNA particle bombardment (see, e.g., Klein et al (1987) Nature 327:70-73, incorporated herein by reference). Alternatively, the DNA constructs may be combined with suitable T-DNA flanking regions and introduced into a conventional *Agrobacterium tumefaciens* host vector. *Agrobacterium tumefaciens*-mediated transformation techniques, including disarming and use of binary vectors, are well described in the scientific literature. See, for example Horsch et al (1984) Science 233:496-498, and Fraley et al (1983) Proc. Nat'l. Acad. Sci. USA 80:4803, incorporated herein by reference. The virulence functions of the *Agrobacterium tumefaciens* host will direct the insertion of the construct and adjacent marker into the plant cell DNA when the cell is infected by the bacteria using binary T DNA vector (Bevan (1984) Nuc. Acid Res. 12:8711-8721, incorporated herein by reference) or the co-cultivation procedure (Horsch et al (1985) *Science* 227:1229-1231, incorporated herein by reference). Generally, the *Agrobacterium* transformation system may be used to engineer dicotyledonous plants (Bevan et al (1982) Ann. Rev. Genet 16:357-384; Rogers et al (1986) Methods Enzymol. 118:627-641, incorporated herein by reference). The *Agrobacterium* transformation system may also be used to transform, as well as transfer, DNA to monocotyledonous plants and plant cells. See Hemalsteen et al (1984) EMBO J 3:3039-3041; Hooykass-Van Slogteren et al (1984) Nature 311:763-764; Grimsley et al (1987) Nature 325:1677-179; Boulton et al (1989) Plant Mol. Biol. 12:31-40; and Gould et al (1991) Plant Physiol. 95:426-434, all incorporated herein by reference.

Alternative gene transfer and transformation methods include, but are not limited to, protoplast transformation through calcium-, polyethylene glycol (PEG)- or electroporation-mediated uptake of naked DNA (see Paszkowski et al. (1984) EMBO J3:2717-2722, Potrykus et al. (1985) Molec. Gen. Genet. 199:169-177; Fromm et al. (1985) Proc. Nat. Acad. Sci. USA 82:5824-5828; and Shimamoto (1989) Nature 338:274-276, all incorporated herein by reference) and electroporation of plant tissues (D'Halluin et al. (1992) Plant Cell 4:1495-1505, incorporated herein by reference). Additional methods for plant cell transformation include microinjection, silicon carbide mediated DNA uptake (Kaeppler et al. (1990) Plant Cell Reporter 9:415-418, incorporated herein by reference), and microprojectile bombardment (see Klein et al. (1988) Proc. Nat. Acad. Sci. USA 85:4305-4309; and Gordon-Kamm et al. (1990) Plant Cell 2:603-618, all incorporated herein by reference).

The present systems and methods can be used to insert exogenous sequences into a predetermined location in a plant cell genome. Accordingly, genes encoding, e.g., nutrients, antibiotics or therapeutic molecules can be inserted, by targeted recombination, into regions of a plant genome favorable to their expression.

Transformed plant cells which are produced by any of the above transformation techniques can be cultured to regenerate a whole plant which possesses the transformed genotype and thus the desired phenotype. Such regeneration techniques rely on manipulation of certain phytohormones in a tissue culture growth medium, typically relying on a biocide and/or herbicide marker which has been introduced together with the desired nucleotide sequences. Plant regeneration from cultured protoplasts is described in Evans, et al., "Protoplasts Isolation and Culture" in Handbook of Plant Cell Culture, pp. 124-176, Macmillian Publishing Company, New York, 1983; and Binding, Regeneration of Plants, Plant Protoplasts, pp. 21-73, CRC Press, Boca Raton, 1985, incorporated herein by reference. Regeneration can also be obtained from plant callus, explants, organs, pollens, embryos or parts thereof. Such regeneration techniques are described generally in Klee et al (1987) Ann. Rev. of Plant Phys. 38:467-486, incorporated herein by reference.

A transformed or genetically modified cell, callus, tissue, or plant can be identified and isolated by selecting or screening the engineered cells for particular traits or activities, e.g., those encoded by marker genes or antibiotic resistance genes. Such screening and selection methodologies are well known to those having ordinary skill in the art. Polynucleotides that are stably incorporated into plant cells can be introduced into other plants using, for example, standard breeding techniques.

A transformed plant cell, callus, tissue or plant may be identified and isolated by selecting or screening the engineered plant material for traits encoded by the marker genes present on the transforming DNA. For instance, selection may be performed by growing the engineered plant material on media containing an inhibitory amount of the antibiotic or herbicide to which the transforming gene construct confers resistance. Further, transformed plants and plant cells may also be identified by screening for the activities of any visible marker genes (e.g., the beta-glucuronidase, luciferase, B or C1 genes) that may be present on the recombinant nucleic acid constructs. Such selection and screening methodologies are well known to those skilled in the art.

Physical and biochemical methods also may be used to identify plant or plant cell transformants containing inserted gene constructs. These methods include but are not limited to: 1) Southern analysis or PCR amplification for detecting and determining the structure of the recombinant DNA insert; 2) Northern blot, S1 RNase protection, primer-extension or reverse transcriptase-PCR amplification for detecting and examining RNA transcripts of the gene constructs; 3) enzymatic assays for detecting enzyme or ribozyme activity, where such gene products are encoded by the gene construct; 4) protein gel electrophoresis, Western blot techniques, immunoprecipitation, or enzyme-linked immunoassays, where the gene construct products are proteins. Additional techniques, such as in situ hybridization, enzyme staining, and immunostaining, also may be used to detect the presence or expression of the recombinant construct in specific plant organs and tissues. The methods for doing all these assays are well known to those skilled in the art.

Effects of gene manipulation using the methods disclosed herein can be observed by, for example, northern blots of the RNA (e.g., mRNA) isolated from the tissues of interest. Typically, if the amount of mRNA has increased, it can be assumed that the corresponding endogenous gene is being expressed at a greater rate than before. Other methods of measuring gene and/or CYP74B activity can be used. Different types of enzymatic assays can be used, depending on the substrate used and the method of detecting the increase or decrease of a reaction product or by-product. In addition, the levels of and/or CYP74B protein expressed can be measured immunochemically, i.e., ELISA, RIA, EIA and other antibody-based assays well known to those of skill in the art, such as by electrophoretic detection assays (either with staining or western blotting). The transgene may be selectively expressed in some tissues of the plant or at some developmental stages, or the transgene may be expressed in substantially all plant tissues, substantially along its entire life cycle. However, any combinatorial expression mode is also applicable.

In one aspect, vectors are provided for the *Agrobacterium*-mediated transient expression or stable transformation in tissue cultures or plant tissues. In particular the plasmid vectors for transient expression in plants, plant protoplasts, tissue cultures or plant tissues contain: (1) a DNA-dependent RNA polymerase III (Pol III) promoter (for example, rice snoRNA U3 or U6 promoter) to control the expression of engineered gRNA molecules in the plant cell, where the transcription was terminated by a Pol III terminator (Pol III Term), (2) a DNA-dependent RNA polymerase II (Pol II) promoter (e.g., 35S promoter) to control the expression of one or more proteins/enzymes; (3) a multiple cloning site (MCS) used to insert a DNA sequence encoding a gRNA.

In certain embodiments, to facilitate the *Agrobacterium*-mediated transformation, binary vectors are provided, wherein the engineered transposon-encoded CRISPR-Cas system cassettes from the plant transient expression plasmid vectors are inserted into an *Agrobacterium* transformation vector, for example the pCAMBIA 1300 vector.

In one embodiment, the present system is transiently expressed in plant protoplasts and are not integrated into the genome. For plant species or cultivars that can be regenerated from protoplasts, sequences encoding the components of the present system can be introduced into the binary vectors, such as, for example, the pRGEB32 and pStGEB3 vectors. In one embodiment, the resulting transgenic crop may be backcrossed with wildtype plants to remove the transgene for producing non-transgenic cultivars. In one embodiment, herbicide-tolerant crops can be generated by substitutions of specific nucleotides in plant genes such as those encoding acetolactate synthase (ALS) and protoporphyrinogen oxidase (PPO).

The present systems and methods may be specific for one target site, or may be specific for 2, 3, 4, 5, 6, 7, 8, 9, 10 or more target sites.

b. Animal

The present invention relates to systems and methods for genetic engineering in animal genomes using engineered transposon-encoded CRISPR (cluster regularly interspaced short palindromic repeats)-Cas system. Genetically modified animals can be produced using these systems and methods.

As used herein, genetically modified animals include an animal into which has been introduced an exogenous polynucleotide. Genetically modified animals also include an animal that has been genetically manipulated such that endogenous nucleotides have been altered to include a mutation, such as a deletion, an insertion, a transition, a transversion, or a combination thereof. For instance, an endogenous coding region could be deleted. Such mutations may result in a polypeptide having a different amino acid sequence than was encoded by the endogenous polynucleotide. Another example of a genetically modified animal is one having an altered regulatory sequence, such as a promoter, to result in increased or decreased expression of an operably linked endogenous coding region.

Non-limiting examples of animals that may be genetically modified using the present systems and methods include: mammals such as primates (e.g., ape, chimpanzee, macaque), rodents (e.g., mouse, rabbit, rat), canine or dog, livestock (cow/bovine, donkey, sheep/ovine, goat or pig), fowl or poultry (e.g., chicken), and fish (e.g., zebra fish). The present methods and systems may be used in other eukaryotic model organisms, e.g. *Drosophila, C. elegans*, etc.

In certain embodiments, the mammal is a human, a non-human primate (e.g., marmoset, rhesus monkey, chimpanzee), a rodent (e.g., mouse, rat, gerbil, Guinea pig, hamster, cotton rat, naked mole rat), a rabbit, a livestock animal (e.g., goat, sheep, pig, cow, cattle, buffalo, horse, camelid), a pet mammal (e.g., dog, cat), a zoo mammal, a marsupial, an endangered mammal, and an outbred or a random bred population thereof.

The term "livestock animal" includes animals traditionally raised in livestock farming, such as cattle (e.g., beef cattle, dairy cattle), pigs, sheep, goats, horses, mules, buffalo, and camels. The term also includes birds raised commercially for meat or eggs (i.e., chickens, turkeys, ducks, geese, guinea fowl, and squabs).

The present cells, tissues and organs may be used for transplantation, such as xenograft. The graft may comprise cells, a tissue or an organ. In one embodiment, the graft comprises hematopoietic stem cells. In another embodiment, the graft comprises bone marrow. In yet another embodiment, the graft comprises a heart, a kidney, a liver, a pancreas, a lung, an intestine, skin, a small bowel, a trachea, a cornea, or combinations thereof.

The present disclosure provides for an engineered transposon-encoded CRISPR-Cas system for RNA-guided DNA integration in an animal cell, comprising: (i) at least one Cas protein, (ii) a guide RNA (gRNA), and (iii) a Tn7-like transposon system.

Also encompassed by the present disclosure is a system for RNA-guided DNA integration in an animal cell, comprising: (i) one or more vectors encoding an engineered CRISPR-Cas system, wherein the CRISPR-Cas system comprises: (a) at least one Cas protein, and (b) a guide RNA (gRNA); and (ii) one or more vectors encoding a Tn7-like transposon system, wherein the CRISPR-Cas system and the transposon system are on same or different vector(s).

The present disclosure provides for an engineered transposon-encoded CRISPR-Cas system for RNA-guided DNA integration in an animal cell, comprising: (i) at least one Cas protein, (ii) a guide RNA (gRNA), and (iii) an engineered transposon system.

The present disclosure also provides for a system for RNA-guided DNA integration in an animal cell, comprising: (i) one or more vectors encoding an engineered CRISPR-Cas system, wherein the CRISPR-Cas system comprises: (a) at least one Cas protein, and (b) a guide RNA (gRNA); and (ii) one or more vectors encoding an engineered transposon system, wherein the CRISPR-Cas system and the transposon system are on same or different vector(s).

The present disclosure provides for a method for RNA-guided DNA integration in an animal cell, the method comprising introducing into the animal cell an engineered transposon-encoded CRISPR-Cas system, wherein the transposon-encoded CRISPR-Cas system comprises: (i) at least one Cas protein, (ii) a guide RNA (gRNA) specific for a target site, (iii) an engineered transposon system, and (iv) a donor DNA, wherein the transposon-encoded CRISPR-Cas system integrates the donor DNA proximal to the target site.

The system and methods may further comprise a donor DNA. The donor DNA comprises a cargo nucleic acid and transposon end sequences. The transposon-encoded CRISPR-Cas system may integrate the donor DNA into the genome of the plant cell.

The cargo nucleic acid may be flanked by transposon end sequences. The integration may be about 46-bp to 55-bp downstream of the target site. The integration may be about 47-bp to 51-bp downstream of the target site.

The target site may be flanked by a protospacer adjacent motif (PAM).

The transposon system may be a bacterial Tn7-like transposon system. Tn7 may transpose via a cut-and-paste mechanism, Class II. Choi et al. PNAS 110(22):E2038-E2045 (2013); Ivics et al. Nature Methods 6(6): 415-422 (2009). The Tn7-like transposon system may be derived from *Vibrio cholerae, Vibrio cholerae, Photobacterium iliopiscarium, Pseudoalteromonas* sp. P1-25, *Pseudoalteromonas ruthenica, Photobacterium ganghwense, Shewanella* sp. UCD-KL21, *Vibrio diazotrophicus, Vibrio* sp. 16, *Vibrio* sp. F12, *Vibrio splendidus, Aliivibrio wodanis*, and *Parashewanella spongiae*. The engineered transposon-encoded CRISPR-Cas system may be from a bacteria selected from the group consisting of: *Vibrio cholerae* strain 4874, *Photobacterium iliopiscarium* strain NCIMB, *Pseudoalteromonas* sp. P1-25, *Pseudoalteromonas ruthenica* strain S3245, *Photobacterium ganghwense* strain JCM, *Shewanella* sp. UCD-KL21, *Vibrio cholerae* strain OYP7G04, *Vibrio cholerae* strain M1517, *Vibrio diazotrophicus* strain 60.6 F, *Vibrio* sp. 16, *Vibrio* sp. F12, *Vibrio splendidus* strain UCD-SED 10, *Aliivibrio wodanis* 06/09/160, and *Parashewanella spongiae* strain HJ039. In one embodiment, the Tn7-like transposon system is derived from *Vibrio cholerae*

Tn6677. The system can encompass gain-of-function Tn7 mutants (Lu et al. EMBO 19(13):3446-3457 (2000); U.S. Patent Publication No. 20020188105) as well as replicative Tn7 transposition mutants (May et al. *Science* 272: 401-404 (1996)).

The transposon system may comprise TnsD or TniQ. The present system may comprise TnsA, TnsB and TnsC. The present system may comprise TnsB and TnsC.

The system may be derived from a Class 1 CRISPR-Cas system. The present system may be derived from a Class 2 CRISPR-Cas system. The present system may be derived from a Type I CRISPR-Cas system. The present system may be derived from a Type V CRISPR-Cas system.

The present system may be nuclease-deficient. The present system may comprise Cas6, Cas7, Cas8 and Cas5. Cas8 and Cas5 may be a fusion protein. The system may comprise a Cascade complex. The present system may comprise C2c5 (Cas12k).

The present disclosure provides for a modified animal cell produced by the present system and method, an animal comprising the animal cell, a population of cells comprising the cell, tissues, and at least one organ of the animal. The present disclosure further encompasses the progeny, clones, cell lines or cells of the genetically modified animal.

The present disclosure provides a genetically modified animal. The genetically modified animal may be homozygous or heterozygous for the genetic modification.

Non-limiting examples of animals that may be genetically modified using the present systems and methods include: mammals such as primates (e.g., ape, chimpanzee, macaque), rodents (e.g., mouse, rabbit, rat), canine or dog, livestock (cow/bovine, sheep/ovine, goat or pig), fowl or poultry (e.g., chicken), and fish (e.g., zebra fish).

In certain embodiments, the mammal is a human, a non-human primate (e.g., marmoset, rhesus monkey, chimpanzee), a rodent (e.g., mouse, rat, gerbil, Guinea pig, hamster, cotton rat, naked mole rat), a rabbit, a livestock animal (e.g., goat, sheep, pig, cow, cattle, horse, camelid), a pet mammal (e.g., dog, cat), a zoo mammal, a marsupial, an endangered mammal, and an outbred or a random bred population thereof.

The term "livestock animal" includes animals traditionally raised in livestock farming, such as cattle (e.g., beef cattle, dairy cattle), pigs, sheep, goats, horses, mules, buffalo, and camels. The term also includes birds raised commercially for meat or eggs (i.e., chickens, turkeys, ducks, geese, guinea fowl, and squabs).

The present cells, tissues and organs may be used for transplantation, such as xenograft. The graft may comprise cells, a tissue or an organ. In one embodiment, the graft comprises hematopoietic stem cells. In another embodiment, the graft comprises bone marrow. In yet another embodiment, the graft comprises a heart, a kidney, a liver, a pancreas, a lung, an intestine, skin, a small bowel, a trachea, a cornea, or combinations thereof.

The present system and method may be used to modify a stem cell. The term "stem cell" is used herein to refer to a cell that has the ability both to self-renew and to generate a differentiated cell type (see Morrison et al. (1997) Cell 88:287-298, incorporated herein by reference). Stem cells may be characterized by both the presence of specific markers (e.g., proteins, RNAs, etc.) and the absence of specific markers. Stem cells may also be identified by functional assays both in vitro and in vivo, particularly assays relating to the ability of stem cells to give rise to multiple differentiated progeny. Stem cells of interest include pluripotent stem cells (PSCs). The term "pluripotent stem cell" or "PSC" is used herein to mean a stem cell capable of producing all cell types of the organism.

The present disclosure further provides progeny of a genetically modified cell, where the progeny can comprise the same genetic modification as the genetically modified cell from which it was derived. The present disclosure further provides a composition comprising a genetically modified cell.

In some embodiments, a genetically modified host cell can generate a genetically modified organism. For example, the genetically modified host cell is a pluripotent stem cell, it can generate a genetically modified organism. Methods of producing genetically modified organisms are known in the art.

As used herein, genetically modified animals include an animal into which has been introduced an exogenous polynucleotide. Genetically modified animals also include an animal that has been genetically manipulated such that endogenous nucleotides have been altered to include a mutation, such as a deletion, an insertion, a transition, a transversion, or a combination thereof. For instance, an endogenous coding region could be deleted. Such mutations may result in a polypeptide having a different amino acid sequence than was encoded by the endogenous polynucleotide. Another example of a genetically modified animal is one having an altered regulatory sequence, such as a promoter, to result in increased or decreased expression of an operably linked endogenous coding region.

The present disclosure provides for systems and methods for transient expression or stable integration of the transgenes encoding one or more components of the present system for animals.

The present systems and methods may be specific for one target site, or may be specific for 2, 3, 4, 5, 6, 7, 8, 9, 10 or more target sites.

Genetic modification may be assessed using techniques that include, for example, Northern blot analysis of tissue samples obtained from the animal, in situ hybridization analysis, Western analysis, immunoassays such as enzyme-linked immunosorbent assays, and reverse-transcriptase PCR (RT-PCR).

Mammalian expression plasmids may be used for all the necessary components (all genes and the gRNA). Any suitable drug selection or fluorescence-based sorting strategies for identifying cells which underwent targeted integration may be used. The expression plasmids may contain components, such as nuclear localization signals, mammalian promoters, etc.

Gene integration with CRISPR-Cas9 requires introduction of DSBs and the use of synthetic repair donor templates carrying appropriate designed homology arms. Homology donors work with the highest efficiency when supplied as recombinant AAV vectors or ssDNA, but these are also extremely laborious to produce [see e.g. H. Li, M. D. Leonetti, *BioRxiv*, 1-24 (2017)]. Furthermore, cloning of dsDNA donor templates with homology arms can be time-consuming and tedious. In contrast, the disclosed system would obviate the need for homology arms redesigned for every new target site, because the targeting would come exclusively from the guide RNA, and the same donor could be used for any arbitrary target site.

Gene integration with CRISPR-Cas9 and donor templates relies on homology-directed repair (HDR) for proper integration of the donor template. However, HDR efficiencies are known to be extremely low in many different cell types, and the DSBs that precede HDR are always repaired in heterogeneous ways across a cell population: some cells undergo HDR at one or both alleles, whereas far more cells undergo non-homologous end joining (NHEJ) at one or both alleles, which leads to small insertions or deletions being introduced at the target site [reviewed in: K. S. Pawelczak, N. S. Gavande, P. S. VanderVere-Carozza, J. J. Turchi, *ACS Chem Biol.* 13, 389-396 (2018), incorporated herein by reference]. This means that, across a cell population (e.g. as would be edited in a therapeutic or experimental application), only a small percentage of cells undergo the desired site-specific gene integration, whereas a far greater percentage undergoes heterogeneous repairs. In contrast, the RNA-guided transposase mechanism for gene integration would not proceed through a DSB intermediate, and thus would not allow for NHEJ-mediate insertions or deletions to arise; rather, targeting of the DNA leads to direct integration coincident with nucleolytic breakage of the phosphodiester bonds on the target DNA, such that targeting involves direct integration without any other off-pathway alternatives.

The endogenous machinery for HDR is virtually absent in post-mitotic cells (i.e. non-dividing cells, which do not undergo DNA replication), such as neurons and terminally differentiated cells. Thus, there are no options for precise, targeted gene integration in these cell types. The present RNA-guided transposase system/mechanism, on the other hand, would still be readily available as a DNA integration strategy in these cell types.

DSBs, which are necessary precursors for CRISPR-Cas9 mediated HDR pathways for gene integration, are known to pose hazards for cells. DSBs at off-target sites introduce off-target mutations; DSBs can provoke a DNA damage response [E. Haapaniemi, S. Botla, J. Persson, B. Schmierer, J. Taipale, *Nat. Med.* 24, 927-930 (2018), incorporated herein by reference]; DSBs can lead to selection for p53 null cells, which have increased risk of tumorigenesis [R. J. Ihry et al., *Nat. Med.* 24, 939-946 (2018), incorporated herein by reference]; and DSB repair at on-target sites can cause large-scale gene deletions, inversions, or chromosome translocations [M. Kosicki, K. Tomberg, A. Bradley, *Nat Biotechnol.* 36, 765-771 (2018), incorporated herein by reference].

c. Treating a Disease or Condition

The methods described here also provide for treating a disease or condition in a subject. The method may comprise administering to the subject, in vivo, or by transplantation of ex vivo treated cells, a therapeutically effective amount of one or more vectors encoding the present system or the self-transposable nucleic acid sequence. The method may comprise administering the present pharmaceutical compositions to the subject.

A "subject" or "patient" may be human or non-human and may include, for example, animal strains or species used as "model systems" for research purposes, such a mouse model as described herein. Likewise, patient may include either adults or juveniles (e.g., children). Moreover, patient may mean any living organism, preferably a mammal (e.g., human or non-human) that may benefit from the administration of compositions contemplated herein. Examples of mammals include, but are not limited to, any member of the Mammalian class: humans, non-human primates such as chimpanzees, and other apes and monkey species; farm animals such as cattle, horses, sheep, goats, swine; domestic animals such as rabbits, dogs, and cats; laboratory animals including rodents, such as rats, mice and guinea pigs, and the like. Examples of non-mammals include, but are not limited to, birds, fish and the like. In one embodiment of the methods and compositions provided herein, the mammal is a human. The subject may comprise the subject's cells and any cells of the microbiome of the subject.

In some embodiments, the compositions are used to treat a pathogen or parasite on or in a subject by altering the pathogen or parasite. Monogenic diseases include, but are not limited to, (disease(exemplary target gene)): Stargardt Disease (ABCA4), Usher Syndrome (MYO7A), Choroideremia (REP1), Achromatopsia (CNGB3), X-Linked Retinoschisis (RS1), beta-thalassemia (HBB), Sickle Cell Disease (HBB), Hemophilia (Factor IX), Wiskott-Aldrich Syndrome (WAS), X-linked Chronic Granulomatous Disease (CYBB), Mucopolysaccharidosis IIIB (NAGLU), Aromatic L-amino Acid Decarboxylase Deficiency (DDC), Recessive Dystrophic Epidermolysis Bullosa (COL7A1), Mucopolysaccharidosis Type 1 (IDUA), Alpha 1 Antitrypsin Deficiency (SERPINA1), Homozygous Familial Hypercholesterolemia (LDLR), Hutchinson-Gilford progeria syndrome (LMNA), Achondroplasia (FGFR3), MECP2 duplication syndrome (MECP2), Pendred syndrome (PDS), Leber hereditary optic neuropathy (MT-ND1-ND4, ND4L, ND6), Noonan syndrome (PTPN11, SOS1, RAF1, KRAS), Congenital myasthenic syndrome (RAPSN, CHAT, COLQ, DOK7), and Hereditary hemorrhagic telangiectasia (ACVRL1, ENG, SMAD4). The present systems and methods may be used in cancer, Duchenne muscular dystrophy (DMD), sickle cell disease (SCD), β-thalassemia, hereditary tyrosinemia type I (HT1), Leber congenital amaurosis and other forms of inherited/genetic blindness, retinal disease (e.g. choroideremia), haemophilia, severe combined immune deficiency (SCID), adenosine deaminase (ADA) deficiency, Parkinson's disease, and cystic fibrosis.

The present systems and methods may be used for gene inactivation. Gene inactivation may be used for therapies (such as cancer therapy), slowing or preventing aging, genetic analysis, etc.

The present systems and methods may be used in cancer immunotherapy, such as CAR-T therapy, in which chimeric antigen receptors are integrated into T cells designed to recognize particular epitopes particular to certain cancer types (June et al., *N. Engl. J. Med.* 379, 64-73 (2018), incorporated herein by reference). Recent work has shown that CAR-T cells have increased efficacy when the CAR gene is integrated into defined sites in the genome, rather than random sites (Eyquem et al., *Nature.* 543, 113-117 (2017), incorporated herein by reference). The present method offers a safer alternative to generate these kinds of gene products than existing, low efficiency methods that rely on DSBs and HDR.

The present disclosure provides for gene editing methods that can ablate a disease-associated gene (e.g. an oncogene), which in turn can be used for in vivo gene therapy for patients. In some embodiments, the gene editing methods disrupt the pathogenic expression of a disease-associated gene (e.g. an oncogene). In some embodiments, the gene editing methods include donor nucleic acids comprising therapeutic genes. The donor nucleic acid may be selected from modified herpes simplex 1 virus, lipoprotein lipase, beta globin, and Factor IX, adenosine deaminase.

The present systems and methods may be used to deliver an expressible therapeutic molecule, such as a protein, nucleic acid, antibody, or the like to a cell or subject. For example, a promoter (inducible or constitutive) may be linked to a therapeutic nucleic acid (e.g., antisense oligonucleotide, miRNA, etc.) and integrated into a cell so that the cell expressed the therapeutic molecule. Such approaches find use for treating diseases such as cancer, cytomegalovirus retinitis, familiar hypercholesterolemia, hemorrhagic fever viruses, HIV/AIDS, spinal muscular atrophy, Duchenne muscular dystrophy, and hypertriglyceridemia.

In one embodiment, the disclosure provides for introducing one or more vectors encoding the present system or self-transposable nucleic acid sequence into a eukaryotic cell. The cell can be a mitotic and/or post-mitotic cell from any eukaryotic cell or organism (e.g. a cell of a single-cell eukaryotic organism, a plant cell, an algal cell, a fungal cell (e.g., a yeast cell), an animal cell, a cell from an invertebrate animal (e.g. fruit fly, cnidarian, echinoderm, nematode, an insect, an arachnid, etc.), a cell from a vertebrate animal (e.g., fish, amphibian, reptile, bird, mammal), a cell from a mammal, a cell from a rodent, a cell from a human, etc.), or a protozoan cell. Any type of cell may be of interest (e.g. a stem cell, e.g. an embryonic stem (ES) cell, an induced pluripotent stem (iPS) cell, a germ cell; a somatic cell, e.g. a fibroblast, a hematopoietic cell, a neuron, a muscle cell, a bone cell, a hepatocyte, a pancreatic cell, a liver cell, a lung cell, a skin cell; an in vitro or in vivo embryonic cell of an embryo at any stage, e.g., a 1-cell, 2-cell, 4-cell, 8-cell, etc. stage zebrafish embryo; etc.). Cells may be from established cell lines or they may be primary cells, where "primary cells", "primary cell lines", and "primary cultures" are used interchangeably herein to refer to cells and cells cultures that have been derived from a subject and allowed to grow in vitro for a limited number of passages, i.e. splitting of the culture. For example, primary cultures are cultures that may have been passaged 0 times, 1 time, 2 times, 4 times, 5 times, 10 times, or 15 times, but not enough times go through the crisis stage. In some cases, the primary cell lines are maintained for fewer than 10 passages in vitro. Target cells are in some cases unicellular organisms or are grown in culture.

If the cells are primary cells, they may be harvest from an individual by any convenient method. For example, leukocytes may be conveniently harvested by apheresis, leukocytapheresis, density gradient separation, etc., while cells from tissues such as skin, muscle, bone marrow, spleen, liver, pancreas, lung, intestine, stomach, etc. are most conveniently harvested by biopsy. An appropriate solution may be used for dispersion or suspension of the harvested cells. Such solution will generally be a balanced salt solution, e.g. normal saline, phosphate-buffered saline (PBS), Hank's balanced salt solution, etc., conveniently supplemented with fetal calf serum or other naturally occurring factors, in conjunction with an acceptable buffer at low concentration. The cells may be used immediately, or they may be stored, frozen, for long periods of time, being thawed and capable of being reused. In such cases, the cells will usually be frozen in 10% or more DMSO, 50% or more serum, and about 40% buffered medium, or some other such solution as is commonly used in the art to preserve cells at such freezing temperatures, and thawed in a manner as commonly known in the art for thawing frozen cultured cells.

The cell can be a cancer cell. The cell can be a stem cell. Examples of stem cells include pluripotent, multipotent and unipotent stem cells. Examples of pluripotent stem cells include embryonic stem cells, embryonic germ cells, embryonic carcinoma cells and induced pluripotent stem cells (iPSCs). The cell may be an induced pluripotent stem cell (iPSC), e.g., derived from a fibroblast of a subject. In another embodiment, the cell can be a fibroblast.

Cell replacement therapy can be used to prevent, correct or treat a disease or condition, where the methods of the present disclosure are applied to isolated patient's cells (ex vivo), which is then followed by the administration of the genetically modified cells into the patient.

The cell may be autologous or allogeneic to the subject who is administered the cell. As described herein, the genetically modified cells may be autologous to the subject, i.e., the cells are obtained from the subject in need of the treatment, genetically engineered, and then administered to the same subject. Alternatively, the host cells are allogeneic cells, i.e., the cells are obtained from a first subject, genetically engineered, and administered to a second subject that is different from the first subject but of the same species. In some embodiments, the genetically modified cells are allogeneic cells and have been further genetically engineered to reduced graft-versus-host disease.

"Induced pluripotent stem cells," commonly abbreviated as iPS cells or iPSCs, refer to a type of pluripotent stem cell artificially prepared from a non-pluripotent cell, typically an adult somatic cell, or terminally differentiated cell, such as a fibroblast, a hematopoietic cell, a myocyte, a neuron, an epidermal cell, or the like, by introducing certain factors, referred to as reprogramming factors.

The present methods may further comprise differentiating the iPS cell to a differentiated cell. For example, patient fibroblast cells can be collected from the skin biopsy and transformed into iPS cells. See, for example, Dimos J T et al. (2008) *Science* 321:1218-1221; Nature Reviews Neurology 4, 582-583 (November 2008) and Luo et al., Tohoku J. Exp. Med. 2012, 226(2): 151-9, both incorporated herein by reference. The genetic modification by the present systems and methods can be done at this stage. The corrected cell clone can be screened and selected. The corrected cell clone may be then differentiated and tested. Differentiated cells can be transplanted autologously back to the donor patient.

The corrected cells for cell therapy to be administered to a subject described in the present disclosure may be formulated with a pharmaceutically acceptable carrier. For example, cells can be administered alone or as a component of a pharmaceutical formulation. The cells can be administered in combination with one or more pharmaceutically acceptable sterile isotonic aqueous or nonaqueous solutions (e.g., balanced salt solution (BSS)), dispersions, suspensions or emulsions, or sterile powders which may be reconstituted into sterile injectable solutions or dispersions just prior to use, which may contain antioxidants, buffers, bacteriostats, solutes or suspending or thickening agents.

The term "autologous" refers to any material derived from the same individual to whom it is later to be re-introduced into the same individual.

The term "allogeneic" refers to any material derived from a different animal of the same species as the individual to whom the material is introduced. Two or more individuals of the same species are said to be allogeneic to one another.

The present systems and methods may be used to treat cancers, including without limitation, lung cancer, ear, nose and throat cancer, colon cancer, melanoma, pancreatic cancer, mammary cancer, prostate cancer, breast cancer, ovarian cancer, basal cell carcinoma, biliary tract cancer; hematopoietic cancers, bladder cancer; bone cancer; breast cancer; cervical cancer; choriocarcinoma; colon and rectum cancer; connective tissue cancer; cancer of the digestive system; endometrial cancer; esophageal cancer; eye cancer; cancer of the head and neck; gastric cancer; intra-epithelial neoplasm; kidney cancer; larynx cancer; liver cancer; fibroma, neuroblastoma; oral cavity cancer (e.g., lip, tongue, mouth, and pharynx); ovarian cancer; pancreatic cancer; prostate cancer; retinoblastoma; rhabdomyosarcoma; rectal cancer; renal cancer; cancer of the respiratory system; sarcoma; skin cancer; stomach cancer; testicular cancer; thyroid cancer; uterine cancer; cancer of the urinary system, as well as other carcinomas and sarcomas.

Carcinomas are cancers of epithelial origin. Carcinomas intended for treatment with the methods of the present disclosure include, but are not limited to, acinar carcinoma, acinous carcinoma, alveolar adenocarcinoma (also called adenocystic carcinoma, adenomyoepithelioina, cribriform carcinoma and cylindroma), carcinoma adenomatosum, adenocarcinoma, carcinoma of adrenal cortex, alveolar carcinoma, alveolar cell carcinoma (also called bronchiolar carcinoma, alveolar cell tumor and pulmonary adenomatosis), basal cell carcinoma, carcinoma basocellulare (also called basaloma, or basiloma, and hair matrix carcinoma), basaloid carcinoma, basosquamous cell carcinoma, breast carcinoma, bronchioalveolar carcinoma, bronchiolar carcinoma, bronchogenic carcinoma, cerebriform carcinoma, cholangiocellular carcinoma (also called cholangioma and cholangiocarcinoma), chorionic carcinoma, colloid carcinoma, comedo carcinoma, corpus carcinoma, cribriform carcinoma, carcinoma en cuirasse, carcinoma cutaneum, cylindrical carcinoma, cylindrical cell carcinoma, duct carcinoma, carcinoma durum, embryonal carcinoma, encephaloid carcinoma, epibulbar carcinoma, epidermoid carcinoma, carcinoma epitheliale adenoides, carcinoma exulcere, carcinoma fibrosum, gelatiniform carcinoma, gelatinous carcinoma, giant cell carcinoma, gigantocellulare, glandular carcinoma, granulosa cell carcinoma, hair-matrix carcinoma, hematoid carcinoma, hepatocellular carcinoma (also called hepatoma, malignant hepatoma and hepatocarcinoma), Huirthle cell carcinoma, hyaline carcinoma, hypernephroid carcinoma, infantile embryonal carcinoma, carcinoma in situ, intraepidermal carcinoma, intraepithelial carcinoma, Krompecher's carcinoma, Kulchitzky-cell carcinoma, lenticular carcinoma, carcinoma lenticulare, lipomatous carcinoma, lymphoepithelial carcinoma, carcinoma mastitoides, carcinoma medullare, medullary carcinoma, carcinoma melanodes, melanotic carcinoma, mucinous carcinoma, carcinoma muciparum, carcinoma mucocellulare, mucoepidermoid carcinoma, carcinoma mucosum, mucous carcinoma, carcinoma myxomatodes, nasopharyngeal carcinoma, carcinoma nigrum, oat cell carcinoma, carcinoma ossificans, osteoid carcinoma, ovarian carcinoma, papillary carcinoma, periportal carcinoma, preinvasive carcinoma, prostate carcinoma, renal cell carcinoma of kidney (also called adenocarcinoma of kidney and hypemephoroid carcinoma), reserve cell carcinoma, carcinoma sarcomatodes, scheinderian carcinoma, scirrhous carcinoma, carcinoma scroti, signet-ring cell carcinoma, carcinoma simplex, small-cell carcinoma, solanoid carcinoma, spheroidal cell carcinoma, spindle cell carcinoma, carcinoma spongiosum, squamous carcinoma, squamous cell carcinoma, string carcinoma, carcinoma telangiectaticum, carcinoma telangiectodes, transitional cell carcinoma, carcinoma *tuberosum*, tuberous carcinoma, verrucous carcinoma, carcinoma vilosum. In preferred embodiments, the methods of the present disclosure are used to treat subjects having cancer of the breast, cervix, ovary, prostate, lung, colon and rectum, pancreas, stomach or kidney.

Sarcomas are mesenchymal neoplasms that arise in bone and soft tissues. Different types of sarcomas are recognized and these include: liposarcomas (including myxoid liposarcomas and pleiomorphic liposarcomas), leiomyosarcomas, rhabdomyosarcomas, malignant peripheral nerve sheath tumors (also called malignant schwannomas, neurofibrosarcomas, or neurogenic sarcomas), Ewing's tumors (including Ewing's sarcoma of bone, extraskeletal (i.e., non-bone) Ewing's sarcoma, and primitive neuroectodermal tumor [PNET]), synovial sarcoma, angiosarcomas, hemangiosarcomas, lymphangiosarcomas, Kaposi's sarcoma, hemangioendothelioma, fibrosarcoma, desmoid tumor (also called aggressive fibromatosis), dermatofibrosarcoma protuberans (DFSP), malignant fibrous histiocytoma (MFH), hemangiopericytoma, malignant mesenchymoma, alveolar soft-part sarcoma, epithelioid sarcoma, clear cell sarcoma, desmoplastic small cell tumor, gastrointestinal stromal tumor (GIST) (also known as GI stromal sarcoma), osteosarcoma (also known as osteogenic sarcoma)-skeletal and extraskeletal, and chondrosarcoma.

In some embodiments, the cancer to be treated can be a refractory cancer. A "refractory cancer," as used herein, is a cancer that is resistant to the standard of care prescribed. These cancers may appear initially responsive to a treatment (and then recur), or they may be completely non-responsive to the treatment. The ordinary standard of care will vary depending upon the cancer type, and the degree of progression in the subject. It may be a chemotherapy, or surgery, or radiation, or a combination thereof. Those of ordinary skill in the art are aware of such standards of care. Subjects being treated according to the present disclosure for a refractory cancer therefore may have already been exposed to another treatment for their cancer. Alternatively, if the cancer is likely to be refractory (e.g., given an analysis of the cancer cells or history of the subject), then the subject may not have already been exposed to another treatment. Examples of refractory cancers include, but are not limited to, leukemia, melanomas, renal cell carcinomas, colon cancer, liver (hepatic) cancers, pancreatic cancer, Non-Hodgkin's lymphoma and lung cancer.

d. Microbial Gene Inactivation

The present system may be used in various bacterial hosts, including human pathogens that are medically important, and bacterial pests that are key targets within the agricultural industry, as well as antibiotic resistant versions thereof; e.g., pathogenic *Pseudomonas* strains, *Staphylococcus aureus, Pneuomoniae species, Helicobacter pylori*, Enterobacteriaceae, *Campylobacter* spp., *Neisseria Gonorrhoeae, Enterococcus faecium, Acinetobacter Baumannii, E. coli, Klebsiella pneumoniae*, etc.

One reason transposable elements are so pervasive is that they encode the entire protein (and RNA, in this case) machinery to facilitate all steps of the mobilization pathway, namely, transposon DNA excision, DNA targeting, and transposon DNA integration.

The present system may be expressed on conjugative plasmids and be transferred into numerous bacterial phyla in a microbiome setting. Furthermore, by programming the CRISPR arrays synthetically with gRNAs targeting specific conserved regions with a defined set of bacteria within these communities, genetic cargos may be specifically and selectively integrated in bacterial species of interest.

CRISPR arrays may be further programed with gRNAs targeting common and medically relevant antibiotic resistance genes that are known to drive the evolution of multidrug resistant bacteria. Because the present transposon can be selectively integrated at will, the autonomous transposon may be programed to insertionally inactive antibiotic resistance genes, as might be present on plasmids being shared in microbiome environments. An advantage of the present system over pre-existing strategies to use CRISPR and other tools as a target-specific antimicrobial, is that the present transposons may not (or may) kill the targeted bacteria, but merely inactive the multidrug resistance while being permanently integrated into the relevant genomes or plasmids, and thus, continually spreading into the population. The present transposons may be programmed with a panel of gRNAs such that they remain within microbiomes of interest, in a permanent safe-harbor locus, providing a reservoir of RNA-guided transposases that can inactivate pathogenic sequences anytime they are encountered.

Besides the medical context, the present methods and systems may be used in agriculture. For bacterial pests, targeted antimicrobials may be ineffective simply because of scale (e.g., across acres and acres of crops). With the present system, the genetic payload being delivered to kill or incapacitate bacterial pests will do so while simultaneously spreading through the population, increasing in abundance.

The present RNA-guided transposon may serve as a gene drive that could persist in a population while have the target specificity to only drive into the desired genes.

The emergence of antibiotic resistance in bacteria is occurring rapidly on a global scale (Centers for Disease Control and Prevention, Office of Infectious Disease. Antibiotic resistance threats in the United States, 2013. April 2013), with contribution from improper overuse of antibiotics in both clinical and industrial settings. While resistance has been observed for virtually all introduced antibiotics (Centers for Disease Control and Prevention, Office of Infectious Disease. Antibiotic resistance threats in the United States, 2013. April 2013), the development of new drugs has significantly slowed in the last decade due to various economic and regulatory obstacles. In order to combat evolving resistance at a genetic level in bacteria, two concurrent studies demonstrated specific killing of resistant bacteria and elimination of plasmids carrying resistance genes, by utilizing the Cas9 nuclease to induce irreparable, lethal double strand breaks (DSBs) at target sequences within these genes (Bikard et al. Nat Biotechnol. 2014; 32(11):1146-1150; Citorik et al., Nat Biotechnol. 2014; 32(11):1141-1145, both incorporated herein by reference).

However, a major disadvantage is that Cas9 targeting is not efficient enough to eliminate all targets, and killing susceptible cells leads to a strong selection for survivor mutants containing either a mutated Cas9 enzyme, guide RNA (gRNA) array, or the target itself (Yosef et al. Proc Natl Acad Sci USA. 2015; 112(23):7267-7272, incorporated herein by reference). Furthermore, the phage-based delivery methods explored in the studies cannot yet be efficiently applied to a more complex bacteria population in a clinically-relevant setting.

The present systems and methods may be used to inactivate microbial genes. In some embodiments, the gene is an antibiotic resistance gene. For example, the coding sequence of bacterial resistance genes may be disrupted in vivo by insertion of a DNA sequence, leading to non-selective re-sensitization to drug treatment. In one embodiment, in addition to disruption of resistance genes, when the present system acts as a replicative transposon and the present system is incorporated on the inserted cargo, the system can further propagate itself along with the target plasmid. Furthermore, by including spacers targeting bacterial genomes, the construct can also stably insert itself in "safe haven" genomic regions, allowing for stable maintenance of the system and prolonged immunity. In other words, by converting the present system to a replicative mode of action and including the present machinery on the cargo, the system copies itself from the donor to the target resistance gene, and thus propagate itself further along with any subsequent horizontal transfer of the target plasmid. Once introduced into a new cell, spacers in the gRNA array targeting genomic sites lead to insertion of a copy of the construct stably in the genome, completing the cycle.

The present systems and methods may be used to treat a multi-drug resistance bacterial infection in a subject. The present systems and methods may be used for genomic engineering within complex bacterial consortia.

Beyond resistance genes, the system and method may be designed to target any gene or any set of genes, such as virulence or metabolic genes, for clinical and industrial applications in other embodiments.

The present systems and methods may be used to target and eliminate virulence genes from the population, to perform in situ gene knockouts, or to stably introduce new genetic elements to the metagenomic pool of a microbiome.

4. Kits

Also within the scope of the present disclosure are kits for therapeutic uses that include the components of the present system or composition.

The kit may include instructions for use in any of the methods described herein. The instructions can comprise a description of administration of the present system or composition to a subject to achieve the intended effect. The instructions generally include information as to dosage, dosing schedule, and route of administration for the intended treatment. The kit may further comprise a description of selecting a subject suitable for treatment based on identifying whether the subject is in need of the treatment.

The containers may be unit doses, bulk packages (e.g., multi-dose packages) or sub-unit doses. Instructions supplied in the kits of the disclosure are typically written instructions on a label or package insert. The label or package insert indicates that the pharmaceutical compositions are used for treating, delaying the onset, and/or alleviating a disease or disorder in a subject.

The kits provided herein are in suitable packaging. Suitable packaging includes, but is not limited to, vials, bottles, jars, flexible packaging, and the like. Also contemplated are packages for use in combination with a specific device, such as an inhaler, nasal administration device, or an infusion device. A kit may have a sterile access port (for example, the container may be an intravenous solution bag or a vial having a stopper pierceable by a hypodermic injection needle). The container may also have a sterile access port.

Kits optionally may provide additional components such as buffers and interpretive information. Normally, the kit comprises a container and a label or package insert(s) on or associated with the container. In some embodiment, the disclosure provides articles of manufacture comprising contents of the kits described above.

The kit may further comprise a device for holding the present system or composition. The device may include an infusion device, an intravenous solution bag, and/or a vial having a stopper pierceable by a hypodermic needle.

The present disclosure also provides for kits for performing RNA-guided DNA integration in vitro. The kit may include the components of the present system. Optional components of the kit include one or more of the following: (1) buffer constituents, (2) control plasmid, (3) sequencing primers.

Polynucleotides/DNA containing the target site may include, but is not limited to, purified chromosomal DNA, total cDNA, cDNA fractionated according to tissue or expression state (e.g. after heat shock or after cytokine treatment other treatment) or expression time (after any such treatment) or developmental stage, plasmid, cosmid, BAC, YAC, phage library, etc. Polynucleotides/DNA containing the target site may include DNA from organisms such as Homo sapiens, Mus domesticus, Mus spretus, Canis domesticus, Bos, Caenorhabditis elegans, Plasmodium falciparum, Plasmodium vivax, Onchocerca volvulus, Brugia malayi, Dirofilaria immitis, Leishmania, Zea maize, Arabidopsis thaliana, Glycine max, Drosophila melanogaster, Saccharomyces cerevisiae, Schizosaccharomyces pombe, Neurospora, Escherichia coli, Salmonella typhimurium, Bacillus subtilis, Neisseria gonorrhoeae, Staphylococcus aureus, Streptococcus pneumonia, Mycobacterium tuberculosis, Aquifex, Thermus aquaticus, Pyrococcus furiosus, Thermus littoralis, Methanobacterium thermoautotrophicum, Sulfolobus caldoaceticus, and others.

EXAMPLES

The following are examples of the present invention and are not to be construed as limiting.

Example 1

Transposon-Encoded CRISPR-Cas Systems Direct RNA-Guided DNA Integration

Conventional CRISPR-Cas systems maintain genomic integrity by leveraging guide RNAs for the nuclease-dependent degradation of mobile genetic elements, including plasmids and viruses. Here, in an inversion of this paradigm, bacterial Tn7-like transposons have coopted nuclease-deficient CRISPR-Cas systems to catalyze RNA-guided integration of mobile genetic elements into the genome. Programmable transposition of *Vibrio cholerae* Tn6677 in *E. coli* utilized CRISPR- and transposon-associated molecular machineries, including a novel co-complex between Cascade and the transposition protein TniQ. Donor DNA integration occurred in one of two possible orientations at a fixed distance downstream of target DNA sequences and accommodated variable length genetic payloads. Deep sequencing experiments revealed highly specific, genome-wide DNA integration across dozens of unique target sites.

Horizontal gene transfer (HGT), a process that allows genetic information to be transmitted between phylogenetically unrelated species, is a major driver of genome evolution across the three domains of life. Mobile genetic elements (MGE) facilitating HGT are especially pervasive in bacteria and archaea, where viruses, plasmids, and transposons constitute the vast prokaryotic mobilome. In response to the ceaseless assault of genetic parasites, bacteria have evolved numerous innate and adaptive defense strategies for protection, including RNA-guided immune systems conferred by Clustered Regularly Interspaced Short Palindromic Repeats (CRISPR) and CRISPR-associated (cas) genes. The evolution of CRISPR-Cas is linked to the large reservoir of genes provided by MGEs, with core enzymatic machineries involved in both new spacer acquisition (Cas1) and RNA-guided DNA targeting (Cas9 and Cas12) deriving from transposable elements.

The well-studied *E. coli* Tn7 transposon is unique in that it mobilizes via two mutually exclusive pathways, one involving non-sequence-specific integration into the lagging strand template during replication, and a second pathway involving site-specific integration downstream of a conserved genomic sequence. Those Tn7-like transposons that specifically associate with CRISPR-Cas systems lack a key gene involved in DNA targeting, and the CRISPR-Cas systems they encode lack a key gene involved in DNA degradation.

In this Example, a CRISPR-Cas effector complex from *Vibrio cholerae* directed an accompanying transposase to integrate DNA downstream of a genomic target site complementary to a guide RNA. This system exemplifies a facile, site-specific DNA integration without homologous recombination.

Cascade Directs Site-Specific DNA Integration

Figure 6A:
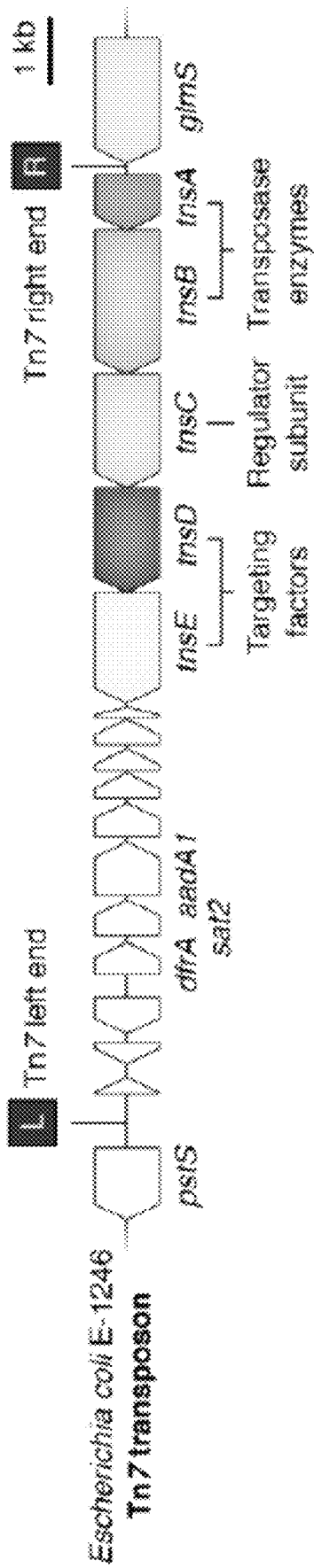
FIGS. 6A-6F show the transposition of the *E. coli* Tn7 transposon and genetic architecture of the Tn6677 transposon from *V. cholerae*.
Figure 6B:
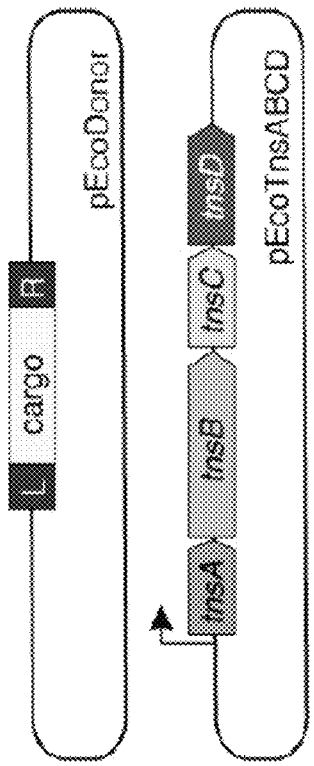
Figure 6C:
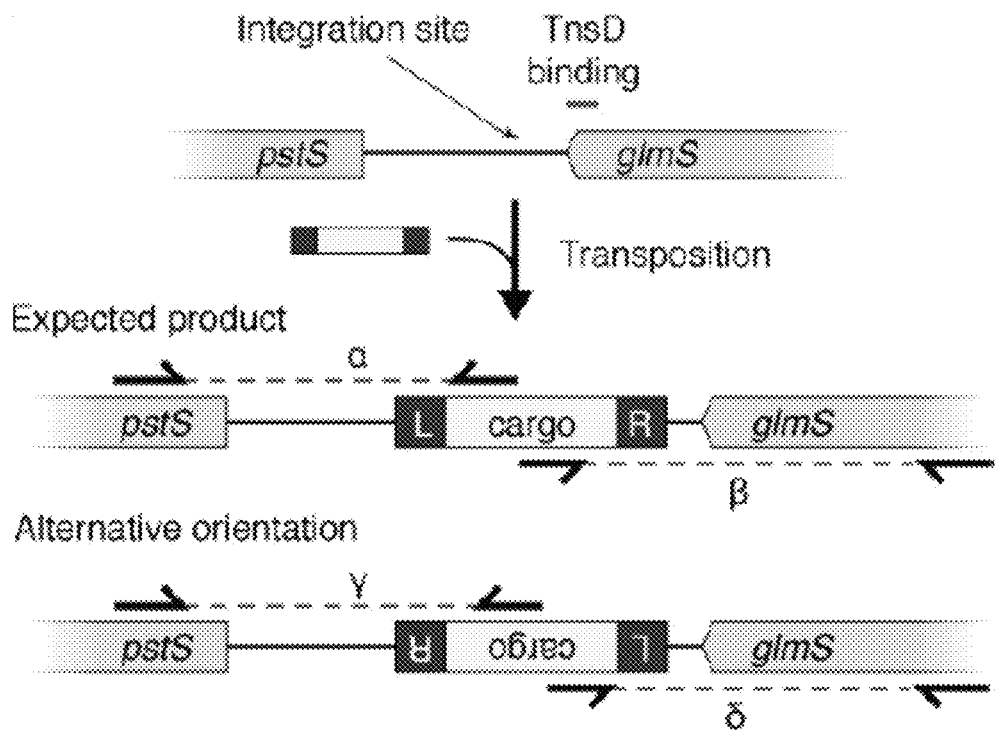
Figure 6D:
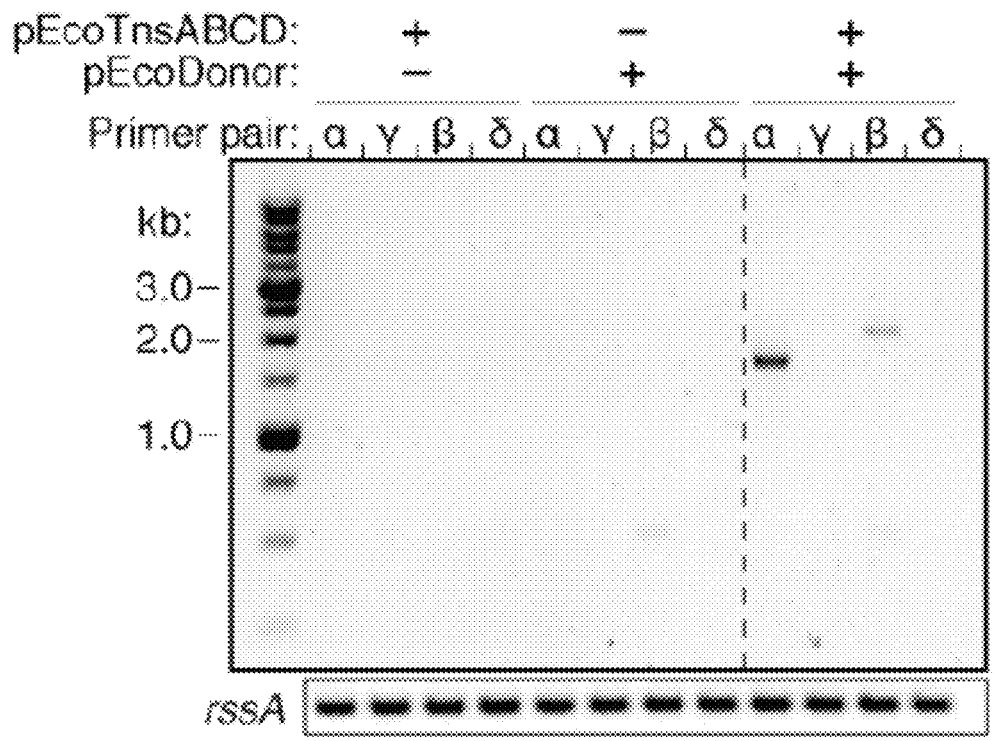
Figure 6E:
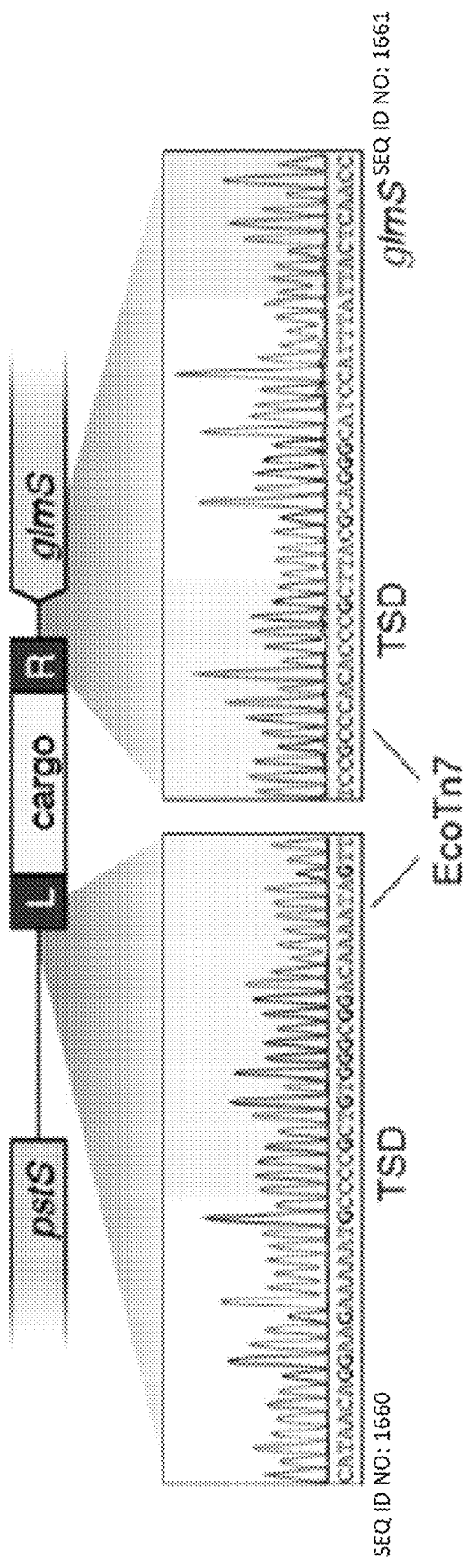

A well-studied cut-and-paste DNA transposon, *E. coli* Tn7, was used to develop assays for monitoring transposition from a plasmid-encoded donor into the genome (FIG. 6A). The Tn7 transposon contains characteristic left and right end sequences and encodes five tns genes, tnsA-E, which collectively encode a heteromeric transposase: TnsA and TnsB are catalytic enzymes that excise the transposon donor via coordinated double-strand breaks; TnsB, a member of the retroviral integrase superfamily, catalyzes DNA integration; TnsD and TnsE constitute mutually exclusive targeting factors that specify DNA integration sites; and TnsC is an ATPase that communicates between TnsAB and TnsD or TnsE. Prior studies have shown that EcoTnsD mediates site-specific Tn7 transposition into a conserved Tn7 attachment site (attTn7) downstream of the glmS gene in *E. coli*, whereas EcoTnsE mediates random transposition into the lagging-strand template during replication. TnsD-mediated transposition was recapitulated by transforming *E. coli* BL21(DE3) cells with pEcoTnsABCD and pEcoDonor, and genomic transposon insertion events were detected by PCR and Sanger sequencing (SEQ ID NOs: 1-139 and FIGS. 6A-F).

Figure 1A:
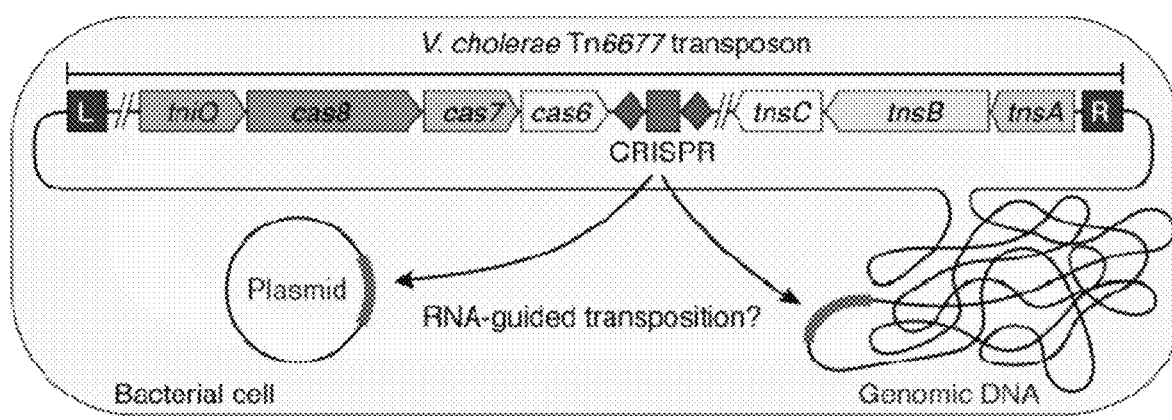
FIGS. 1A-1I show the RNA-guided DNA integration with a *V. cholerae* transposon.
Figure 6F:
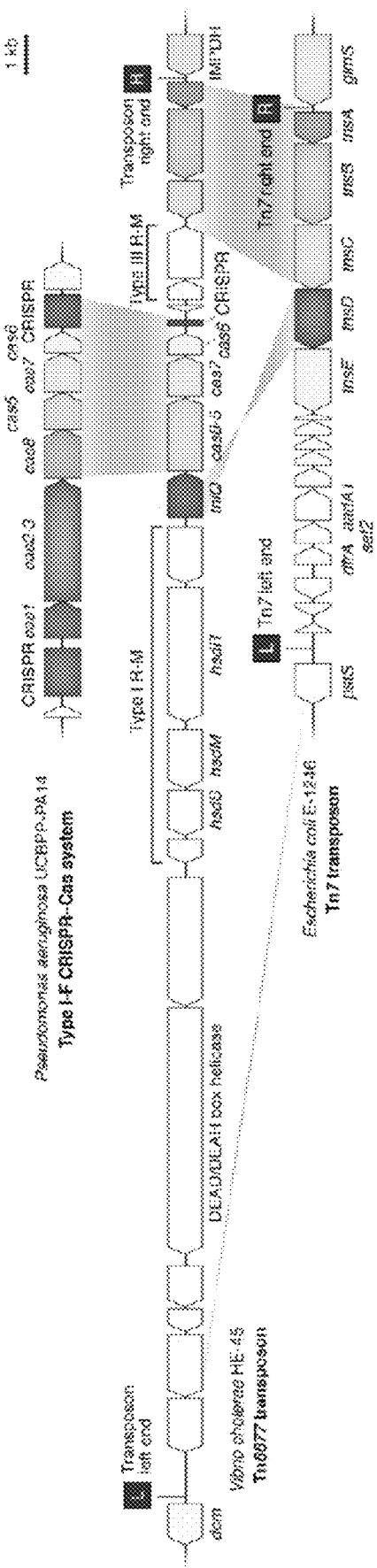
Figure 7A:
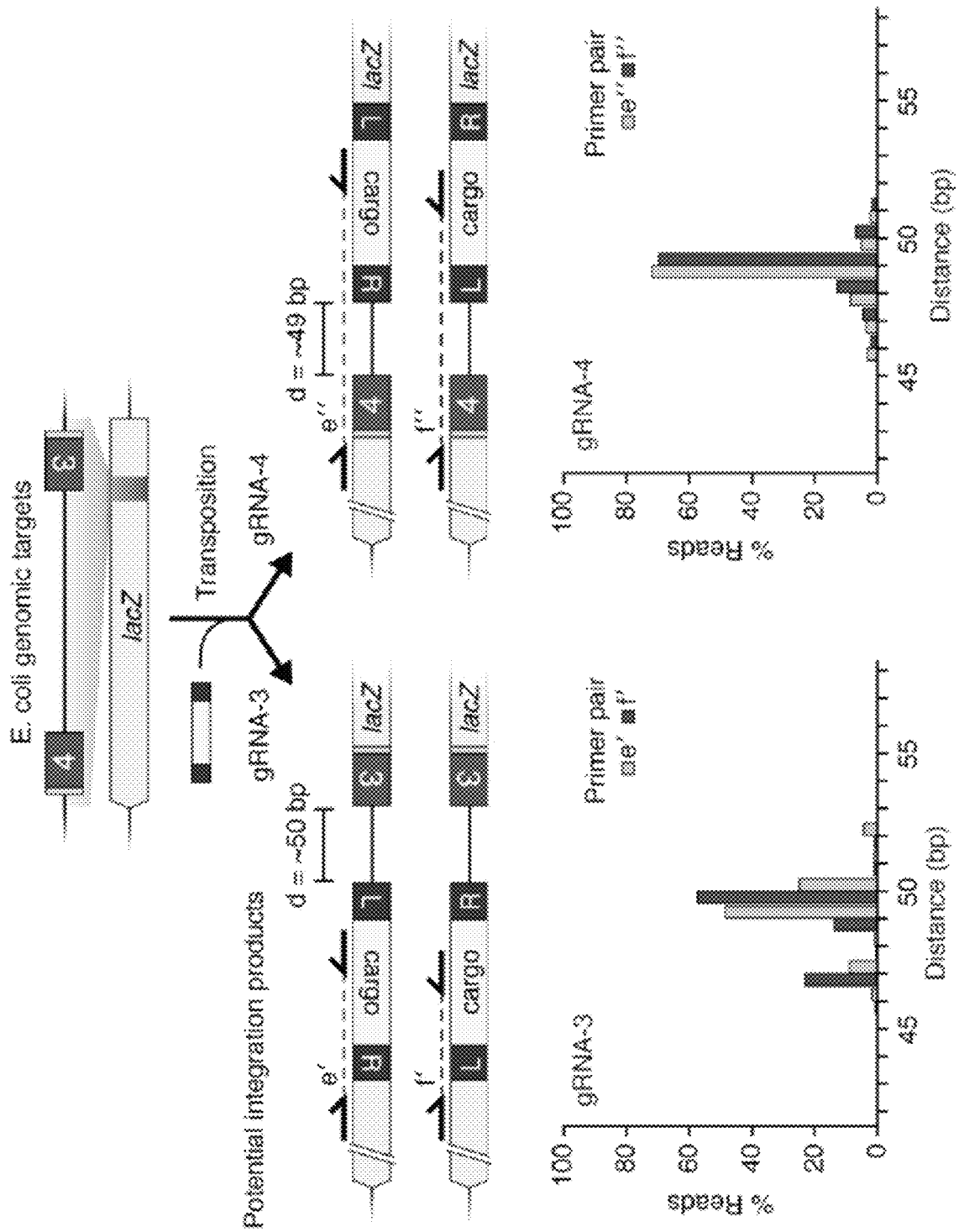
FIGS. 7A-7G are the analysis of *E. coli* cultures and strain isolates harboring lacZ-integrated transposons.
Figure 7B:
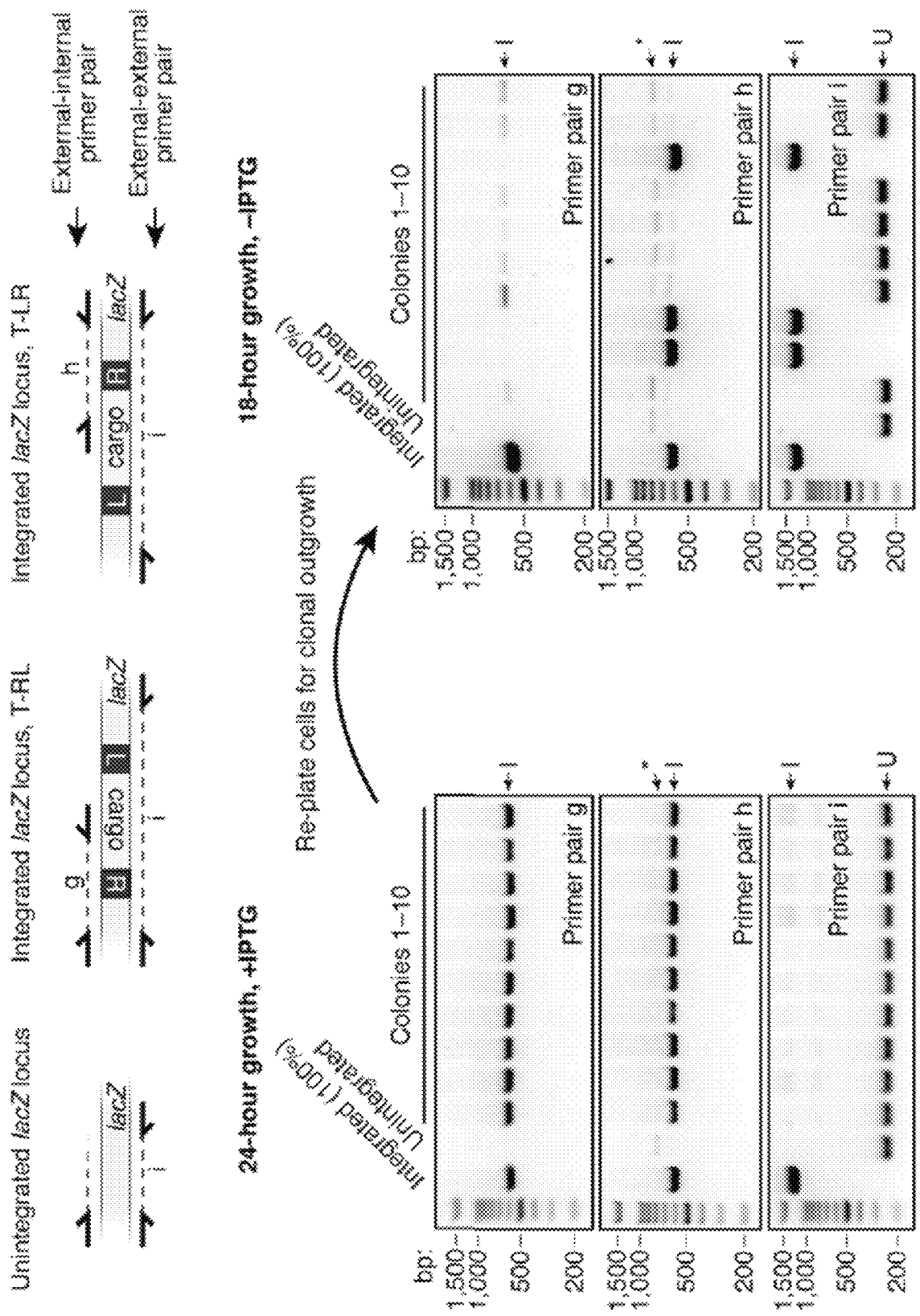
Figure 7C:
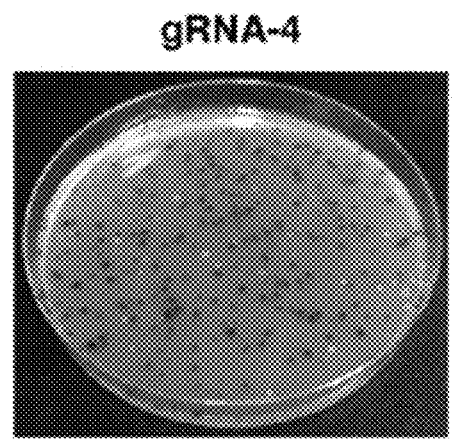
Figure 7D:
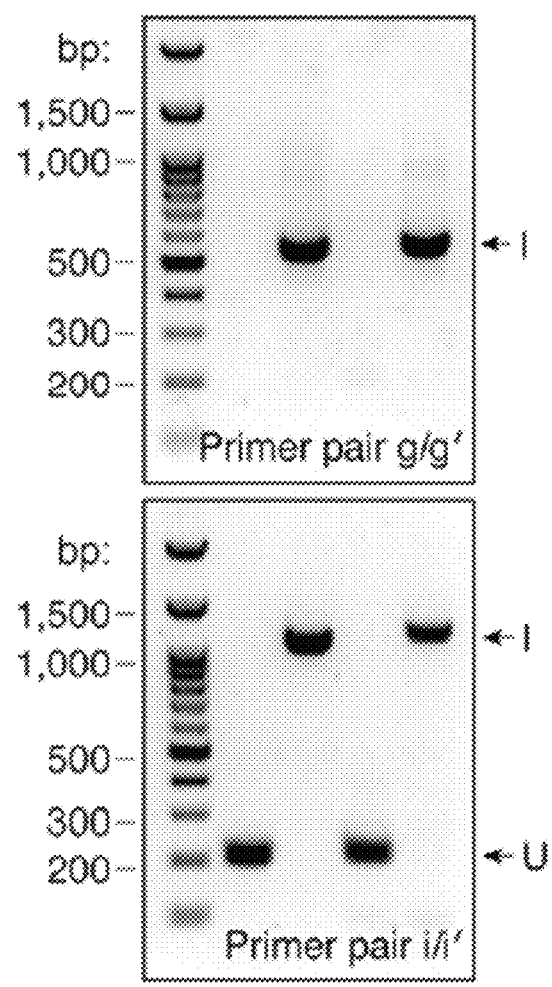
Figure 7E:
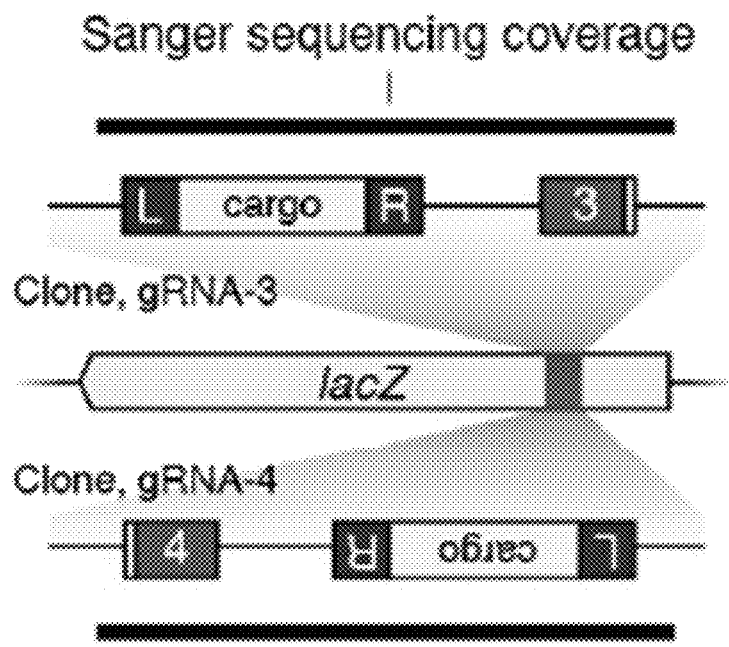
Figure 7F:
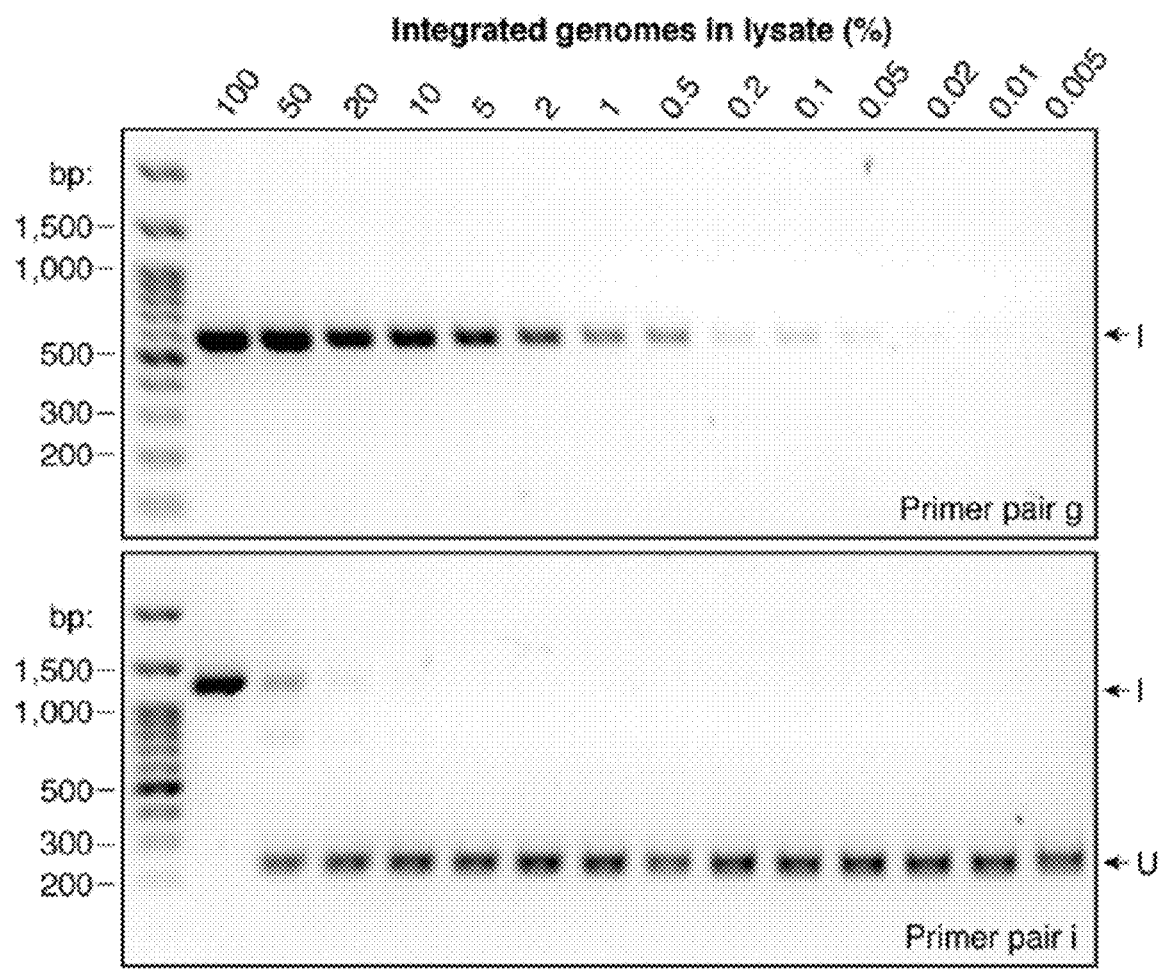
Figure 7G:
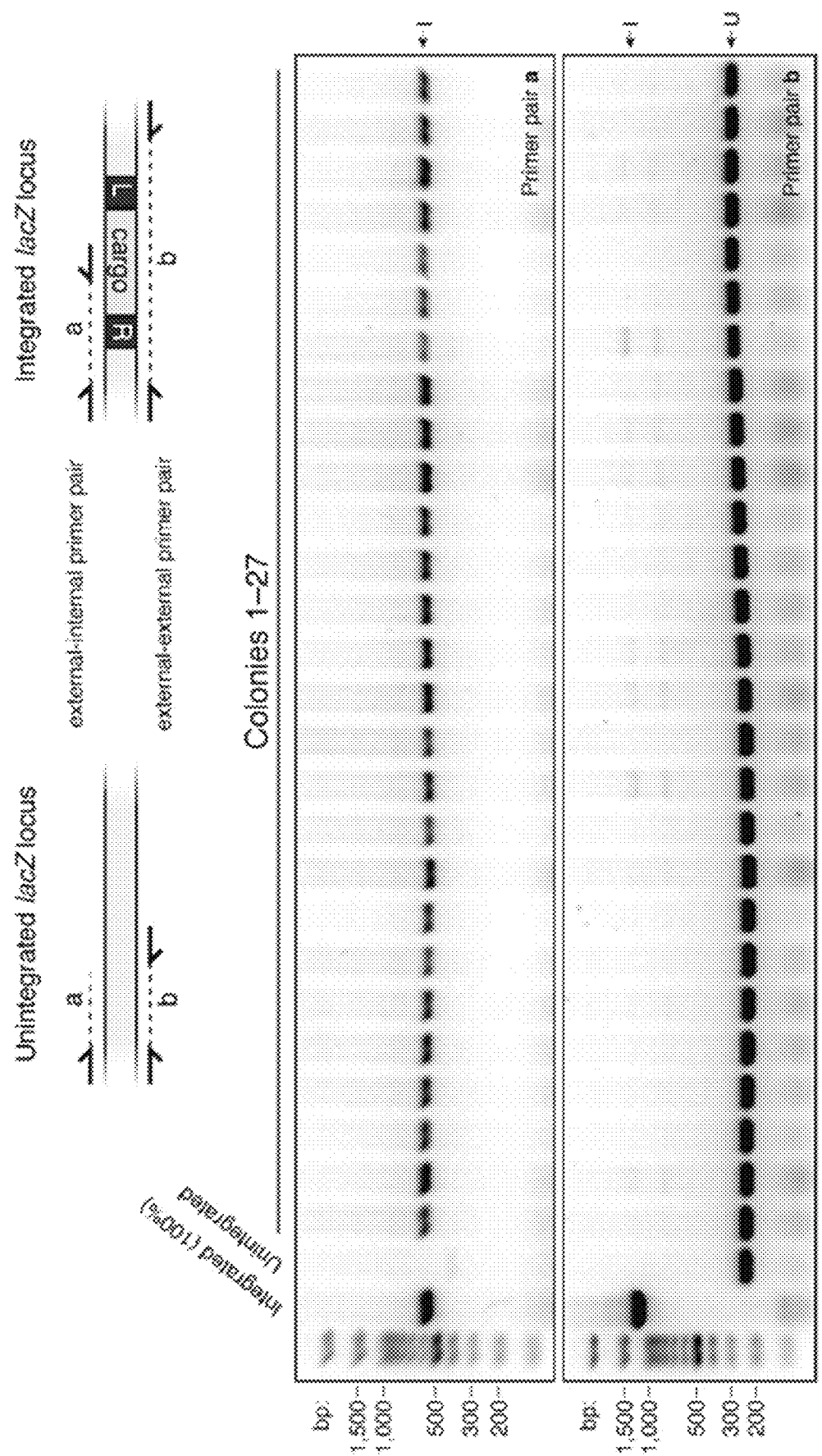

To test whether CRISPR-associated targeting complexes directed transposons to genomic sites complementary to a guide RNA (FIG. 1A), a representative transposon from *Vibrio cholerae* strain HE-45, Tn6677, which encodes a variant Type I-F CRISPR-Cas system (as described in: McDonald, N. D., et al., BMC Genomics 20, 105 (2019) and Makarova, K. S., et al., *The CRISPR Journal* 1, 325-336 (2018), incorporated herein by reference) was selected (FIG. 6F, SEQ ID NOs: 140-153). This transposon is bounded by left and right end sequences, distinguishable by their TnsB binding sites, and includes a terminal operon comprising the tnsA, tnsB, and tnsC genes. Intriguingly, the tniQ gene, a homolog of *E. coli* tnsD, is encoded within the cas operon rather than tns operon, whereas tnsE is absent entirely. Like other such transposon-encoded CRISPR-Cas systems (Peters, J. E., et al., *Proc Natl Acad Sci USA* 114, E7358-E7366 (2017), incorporated herein by reference), the cas1 and cas2 genes responsible for spacer acquisition are absent, as is the cas3 gene responsible for target DNA degradation. The putative DNA-targeting complex Cascade, also known as Csy complex (Hille, F. et al. Cell 172, 1239-1259 (2018), incorporated herein by reference), for this Type I-F variant is encoded by three genes: cas6, cas7, and a natural cas8-cas5 fusion described by Makarova, K. S., et al., *The CRISPR Journal* 1, 325-336 (2018), incorporated herein by reference, (hereafter referred to simply as cas8 in this Example when referring to the Type I-F variant). The native CRISPR array, comprising four repeat and three spacer sequences, encodes distinct mature CRISPR RNAs (crRNAs), which are referred to as guide RNAs (gRNAs).

Figure 1B:
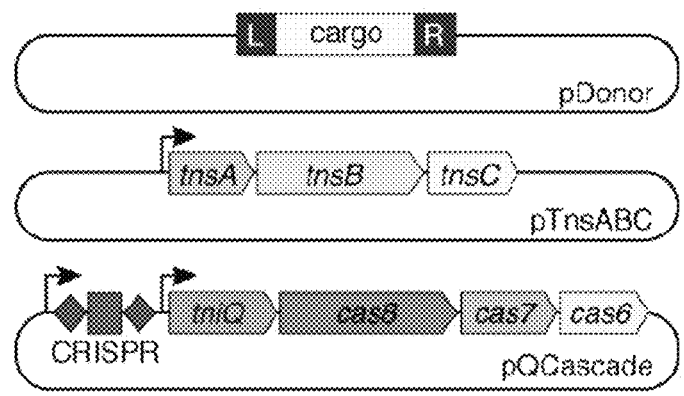
Figure 1C:
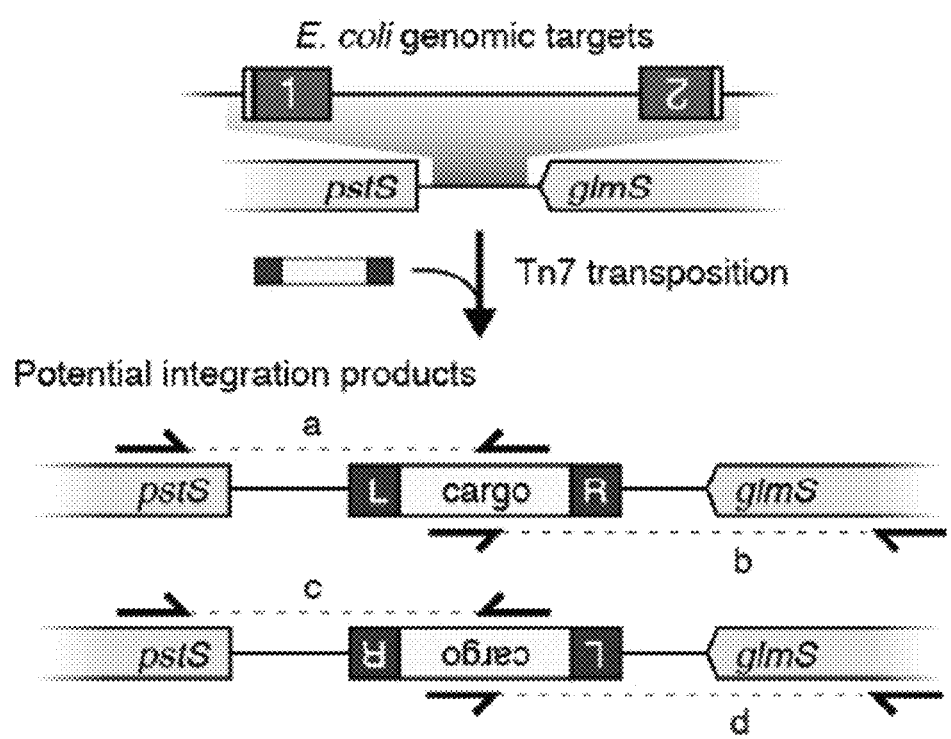

*E. coli* was transformed with plasmids encoding components of the *V. cholerae* transposon, including a transposon donor (pDonor), the tnsA-tnsB-tnsC operon (pTnsABC), and the Type I-F variant tniQ-cas8-cas7-cas6 operon alongside a synthetic CRISPR array (pQCascade) (FIG. 1B). The CRISPR array was designed to produce a non-targeting gRNA (gRNA-nt) or gRNA-1, which targets a genomic site downstream of glmS flanked by a 5'-CC-3' protospacer adjacent motif (PAM) (FIG. 100). PCR products were observed from cellular lysates between a genome-specific primer and either of two transposon-specific primers in experiments containing pTnsABC, pDonor, and pQCascade expressing gRNA-1, but not with gRNA-nt or any empty vector controls (FIGS. 1C and 1D).

Figure 1E:
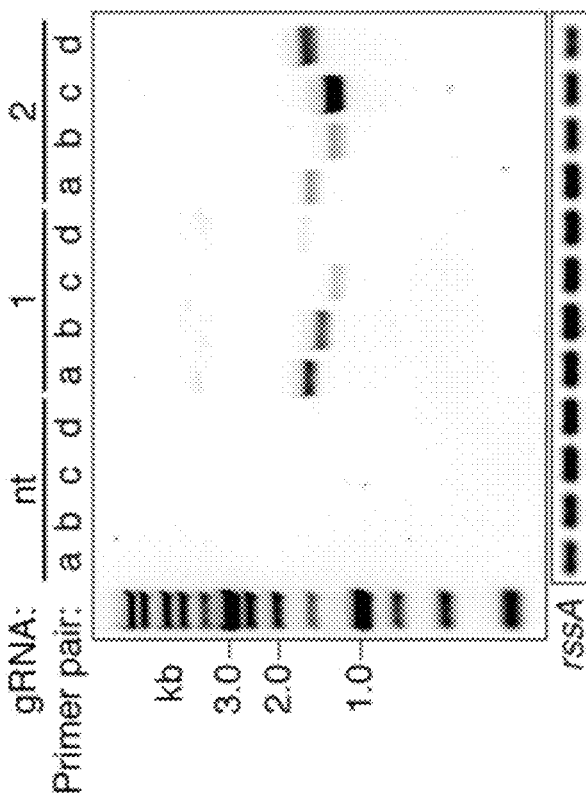

Because parallel reactions with oppositely oriented transposon primers revealed integration events within the same biological sample, RNA-guided transposition might occur in either orientation, unlike *E. coli* Tn7. Additional PCRs adding a downstream genomic primer and targeting an additional site with gRNA-2 found in the same genomic locus but on the opposite strand were performed. For both gRNA-1 and gRNA-2, transposition products in both orientations were present, although with distinct orientation preferences based on relative band intensities (FIG. 1E). Based on the presence of discrete bands, it appeared that integration was occurring a set distance from the target site, and indeed, Sanger and next-generation sequencing (NGS) revealed that >95% of integration events for gRNA-1 occurred 49-bp from the 3' edge of the target site. The observed pattern with gRNA-2 was more complex, with integration clearly favoring distances of 48- and 50-bp over 49-bp. Both sequencing approaches also revealed the expected 5-bp target site duplication (TSD) that is a feature of Tn7 transposition products (FIGS. 1F and 1G).

Figure 1D:
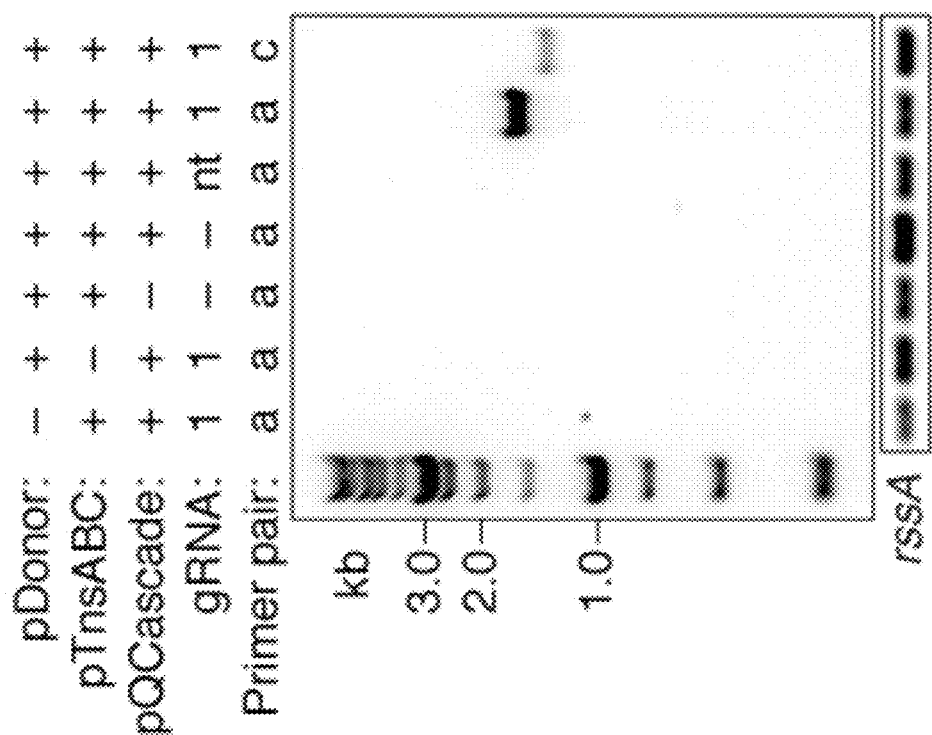
Figure 1F:
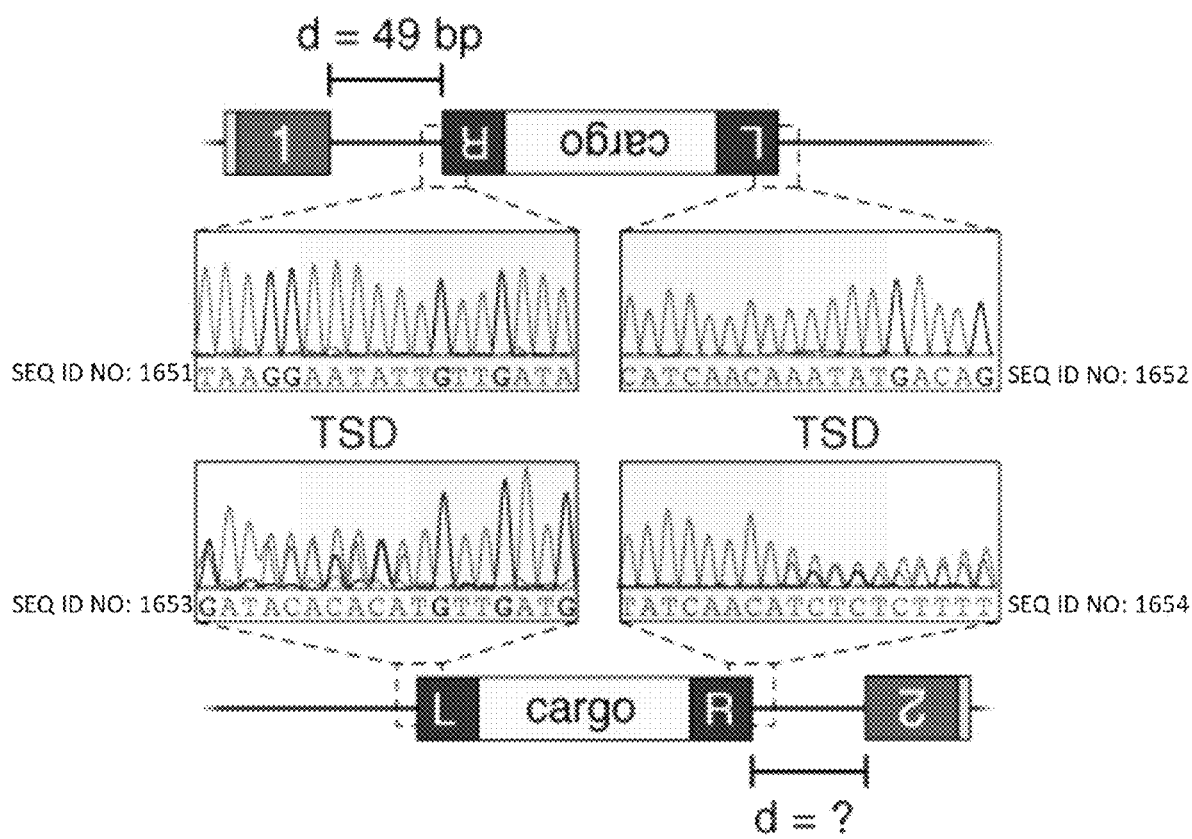
Figures 1G, 1H, 1I:
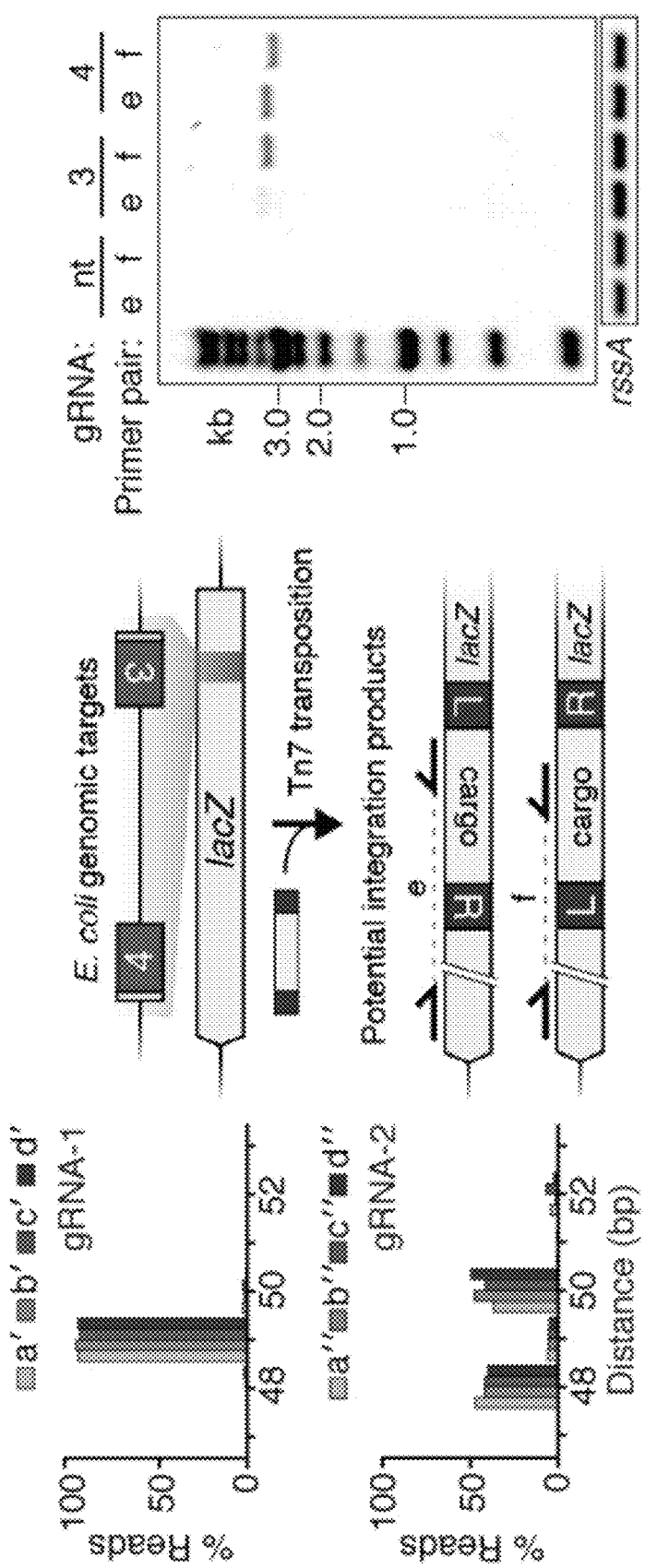

The *V. cholerae* Tn6677 transposon is not naturally present downstream of glmS nor immediately proximal to DNA sequences highly similar to the known EcoTnsD binding site (attTn7), and no evidence of site-specific transposition within this locus was found when the gRNA was omitted (FIG. 1D). Nevertheless, to ensure that integration specificity was solely guided by gRNA sequence, and not by any intrinsic preference for the glmS locus, gRNA-3 and gRNA-4, which target opposite strands within the lacZ coding sequence, were cloned and tested. Bidirectional integration 48-50 bp downstream of both target sites was again observed, and clonally integrated lacZ knockout strains were able to be isolated after performing blue-white colony screening on X-gal-containing LB-agar plates (FIGS. 1H, 1I and 7A-G). Collectively, these experiments demonstrate transposon integration downstream of genomic target sites complementary to guide RNAs.

Protein Requirements of RNA-Guided DNA Integration

Figures 2A, 2B:
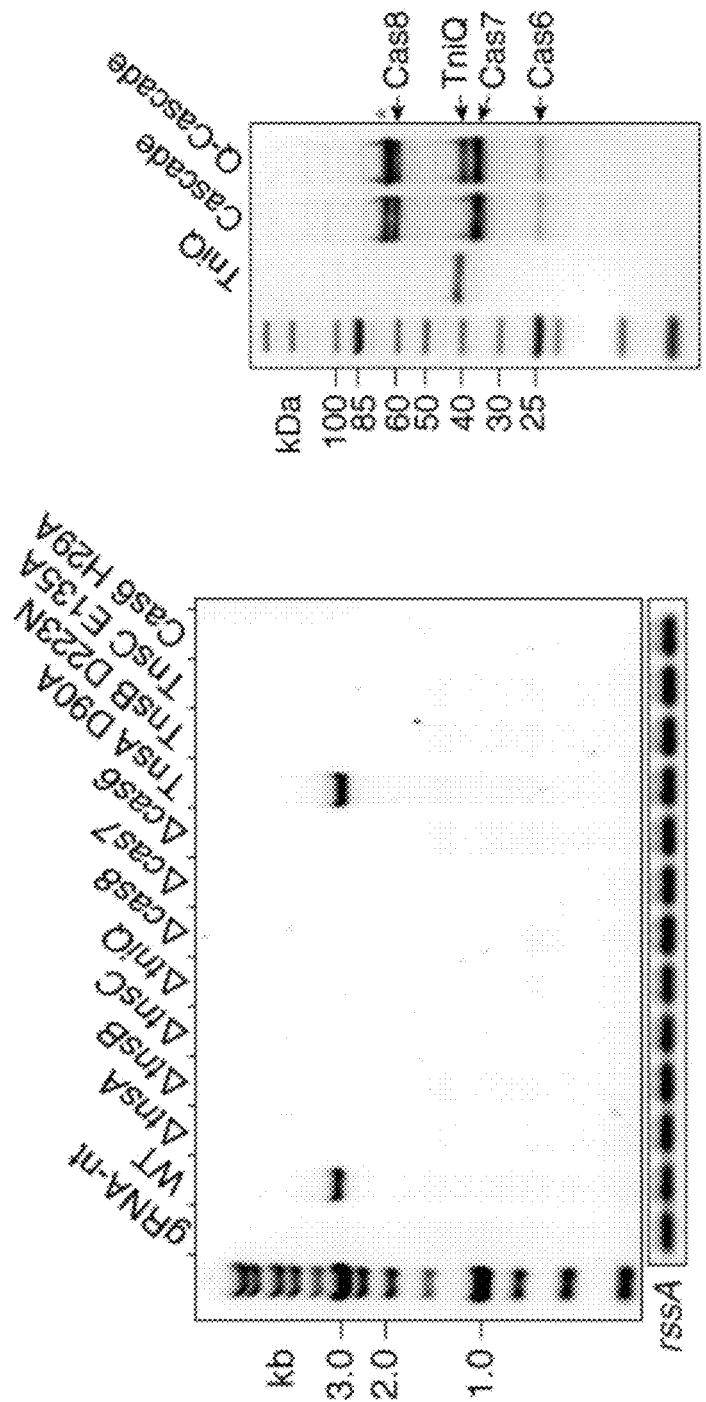
FIGS. 2A-2F show that TniQ forms a complex with Cascade and is used for RNA-guided DNA integration.

To confirm the involvement of transposon- and CRISPR-associated proteins in catalyzing RNA-guided DNA integration, a series of plasmids in which each individual tns and cas gene was deleted, or in which each individual enzymatic active site was mutated were cloned and tested. Removal of any protein component abrogated transposition activity, as did active site mutations in the TnsB transposase, which catalyzes DNA integration, in the TnsC ATPase, which regulates target site selection, and in the Cas6 ribonuclease, which catalyzes gRNA processing (FIG. 2A). A catalytically impaired TnsA mutant still facilitated RNA-guided DNA integration. Based on previous studies of *E. coli* Tn7, this variant system was expected to mobilize via replicative transposition as opposed to cut-and-paste transposition.

Figure 8A:
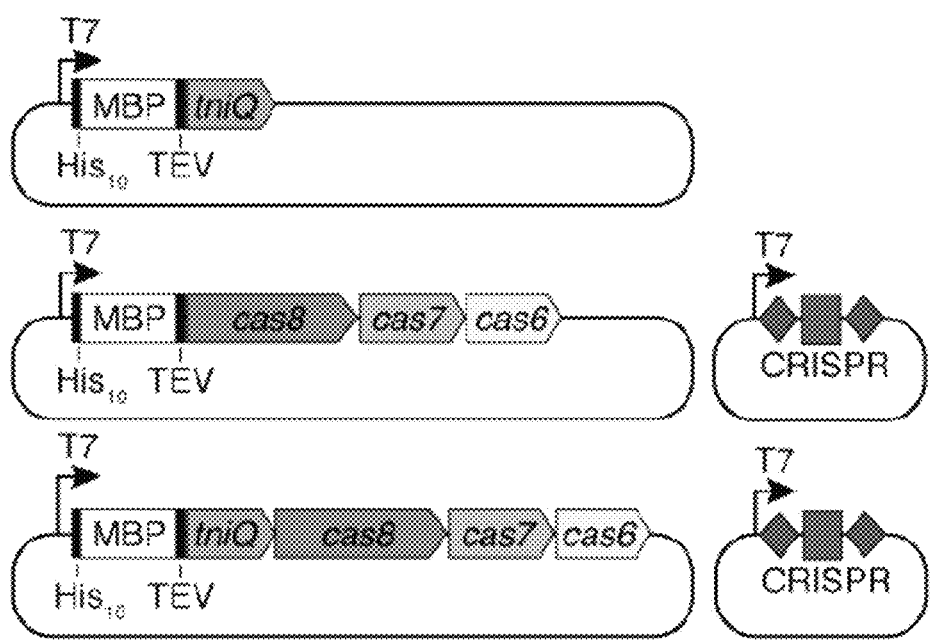

In *E. coli*, site-specific transposition includes attTn7 binding by EcoTnsD, followed by interactions with the EcoTnsC regulator protein to directly recruit the EcoTnsA-TnsB-donor DNA. Given the role of tniQ (a tnsD homolog) in RNA-guided transposition, and its location within the Type I-F variant cas8-cas7-cas6 operon, Cascade might directly bind TniQ and thereby deliver it to genomic target sites. CRISPR RNA and the *V. cholerae* tniQ-cas8-cas7-cas6 operon containing an N-terminal His$_{10}$ tag on the TniQ subunit were recombinantly expressed (FIG. 8A). TniQ co-purified with Cas8, Cas7, and Cas6, as shown by SDS-PAGE and mass spectrometry, and the relative band intensities for each Cas protein were similar to TniQ-free Cascade and consistent with the 1:6:1 Cas8:Cas7:Cas6 stoichiometry described by Wiedenheft, B. et al. (*Proc Natl Acad Sci USA* 108, 10092-10097 (2011), incorporated herein by reference) for a I-F variant Cascade complex (FIG. 2B and FIG. 8B). The complex migrated through a gel filtration column with an apparent molecular weight of ~440 kDa, in good agreement with its approximate expected mass, and both Cascade and TniQ-Cascade co-purified with a 60-nt RNA species, which was confirmed as mature gRNA by deep sequencing (FIGS. 2C, 2D, 8C and 8D). To further validate the interaction between Cascade and TniQ, separately purified samples were incubated in vitro and complex formation was demonstrated by size exclusion chromatography (FIG. 8E). Together, these results revealed the existence of a novel TniQ-Cascade co-complex, representing an example of a type I CRISPR RNA-guided effector complex directly interacting with a non-Cas protein.

Figure 2D:
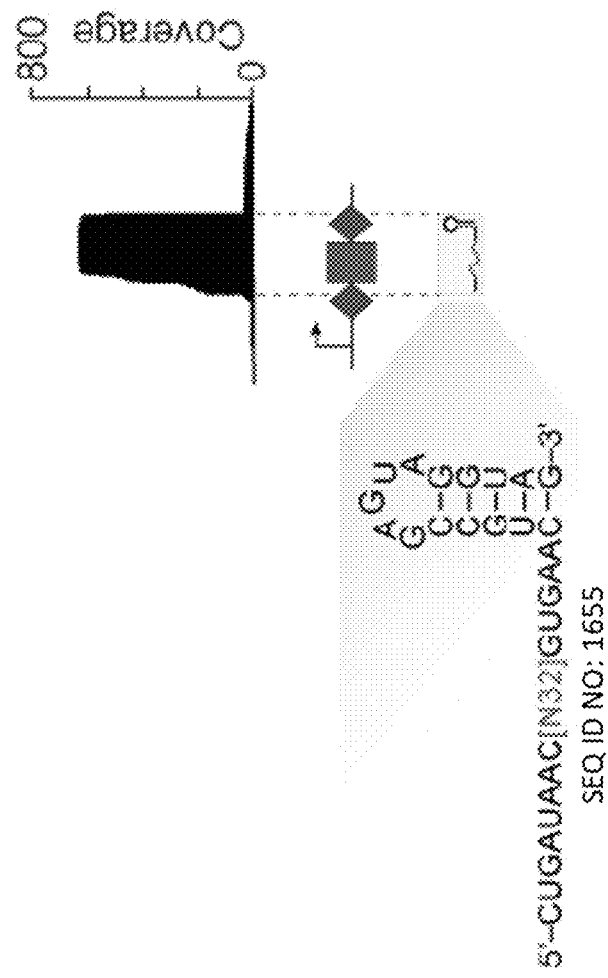
Figure 2C:
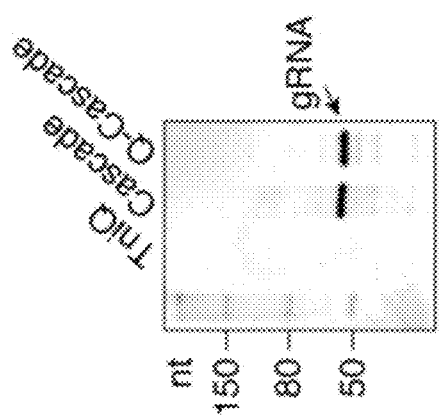
Figure 2E:
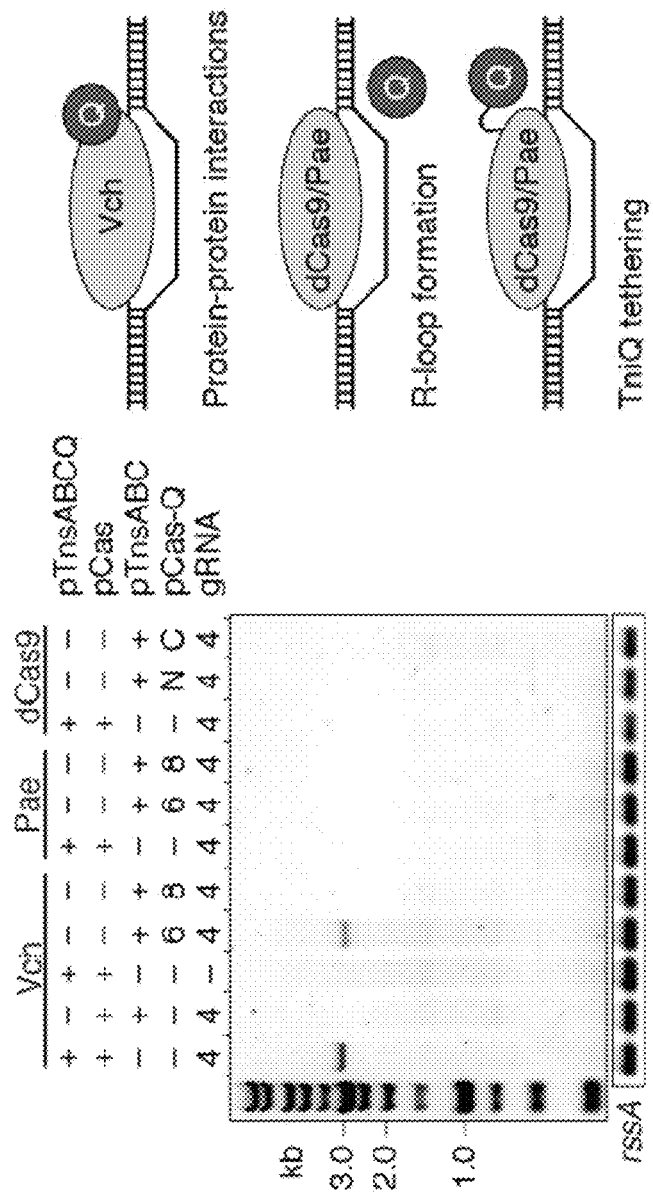

To determine whether specific TniQ-Cascade interactions are required, or if TniQ could direct transposition adjacent to generic R-loop structures or via artificial recruitment to DNA, *S. pyogenes* Cas9 (SpyCas9) and *P. aeruginosa* Cascade (PaeCascade) were used as orthogonal RNA-guided DNA targeting systems. After generating protein-RNA expression plasmids and programming both effector complexes with gRNAs targeting the same lacZ sites as described in the above transposition experiments, DNA targeting was validated by demonstrating efficient cell killing in the presence of an active Cas9 nuclease or the PaeCascade-dependent Cas2-3 nuclease (FIGS. 9A and 9B). When strains harboring pTnsABCQ and pDonor were transformed with a plasmid encoding either catalytically deactivated Cas9-sgRNA (dCas9-sgRNA) or PaeCascade, and PCR analysis of the resulting cell lysate was performed, no evidence of site-specific transposition was found (FIG. 2E), indicating that a genomic R-loop was insufficient for site-specific integration. Transposition when TniQ was directly fused to either terminus of dCas9, or to the Cas8 or Cas6 subunit of PaeCascade was also not detected (FIG. 2E), at least for the linker sequences tested. Interestingly, however, a similar fusion of TniQ to the Cas6 subunit of VchCascade, but not to the Cas8 subunit, restored RNA-guided transposition activity (FIGS. 2E and 9C).

Figure 2F:
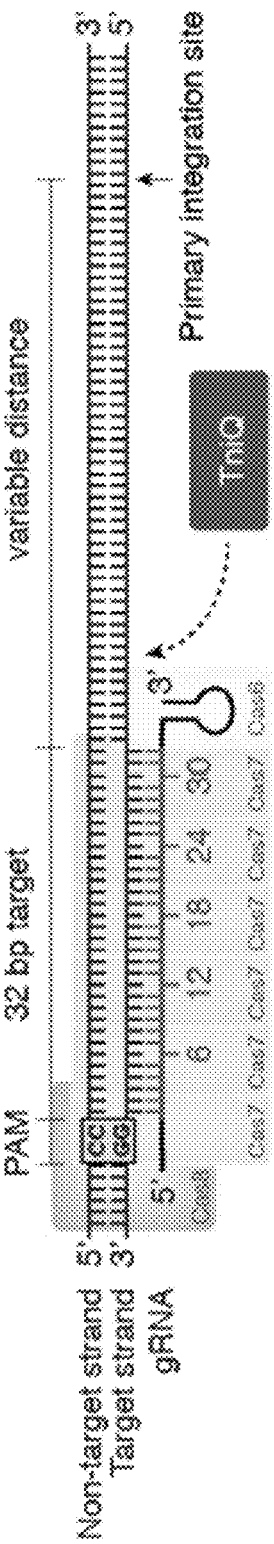

Taken together with the biochemical results, it was concluded that TniQ forms interactions with Cascade, possibly via the Cas6 subunit, which could account for the finding that RNA-guided DNA integration occurs downstream of the PAM-distal end of the target site where Cas6 bound (FIG. 2F). Because TniQ is utilized for transposition in these experiments, it may serve as a functional link between the CRISPR- and transposon-associated machineries during DNA targeting and DNA integration.

Donor DNA Requirements of RNA-Guided DNA Integration

Figure 3C:
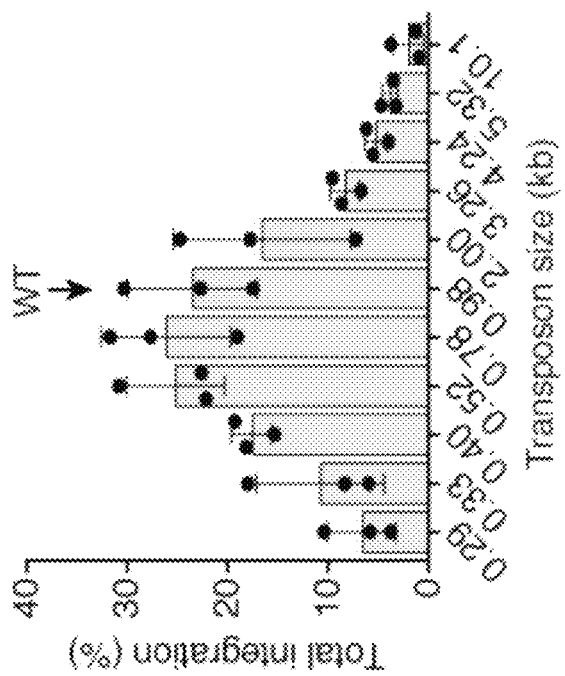
Figure 3B:
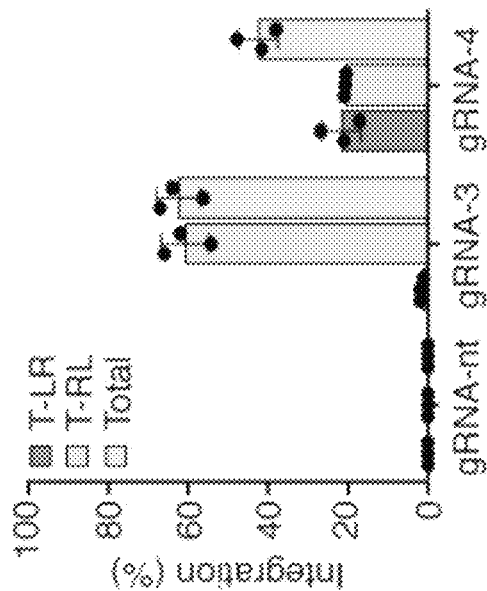
Figure 3A:
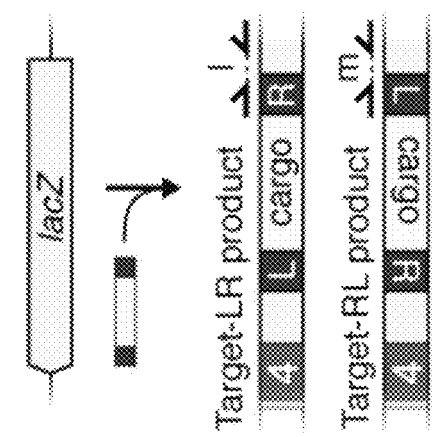

Tn7 transposons are characterized by conserved left and right ends ~100-150 bp in length, which contain 8-bp terminal inverted repeats and three and four ~20-bp TnsB binding sites, respectively (FIG. 11A). To determine the minimal donor requirements for RNA-guided DNA integration, as well as the effects of truncating the transposon ends and altering the cargo size, a quantitative PCR (qPCR) method for scoring transposition efficiency that could accurately and sensitively measure genomic integration events in both orientations was developed (FIG. 10A-10E). Analysis of cell lysates from transposition experiments using lacZ-targeting gRNA-3 and gRNA-4 yielded overall integration efficiencies of 62% and 42% without selection, respectively. The preference for integrating the 'right' vs. the 'left' transposon end proximal to the genomic site targeted by Cascade was 39-to-1 for gRNA-3 and 1-to-1 for gRNA-4, suggesting the existence of additional sequence determinants that regulate integration orientation (FIGS. 3A and 3B). When both ends of the transposon were separately truncated, up to 40-bp and 80-bp of the left and right ends could be deleted without any substantive defect in overall integration efficiency. The dispensable portions of the 'right' end included the third and fourth putative TnsB binding sites, whereas removal of any of the three TnsB binding sites in the left end was detrimental.

Figure 3D:
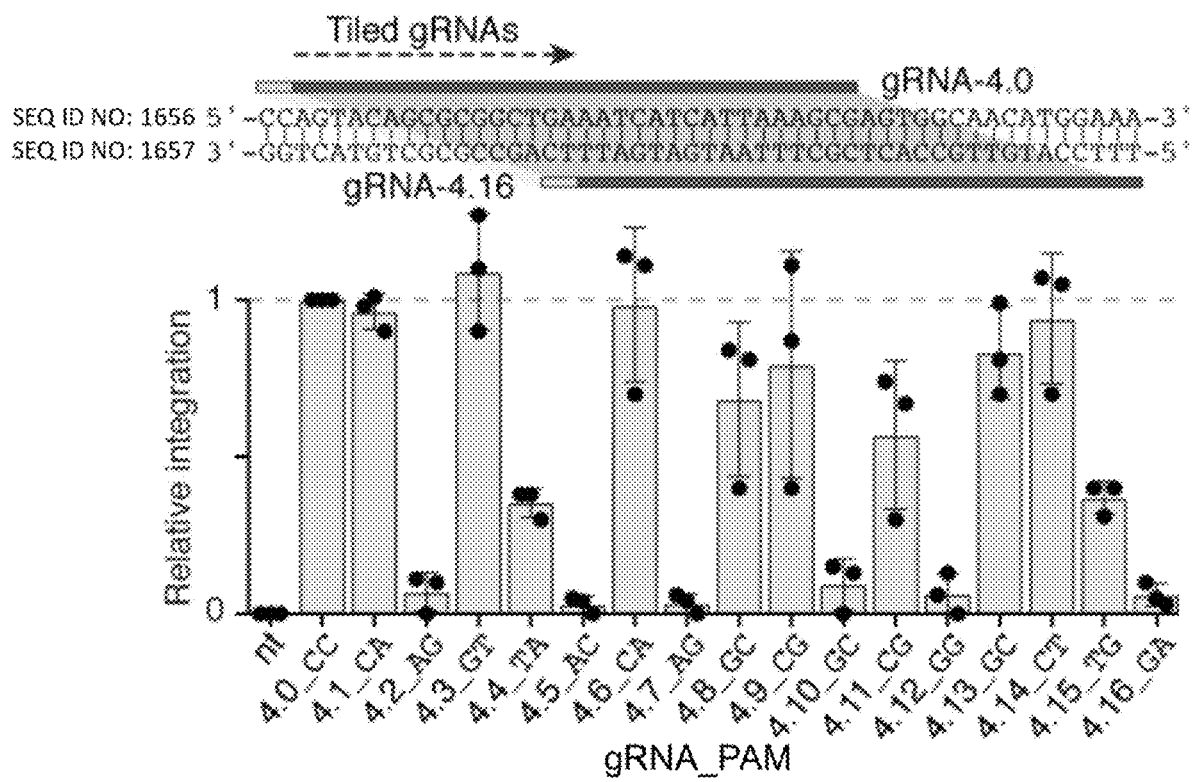
Figure 3E:
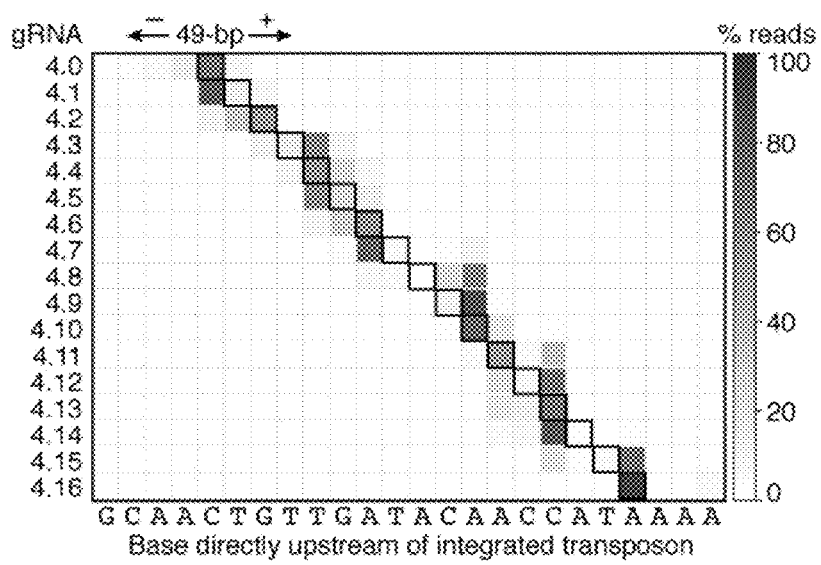

Using this quantitative assay, the effect of transposon size on RNA-guided integration efficiency and possible size constraints were determined. The DNA cargo in between the donor ends, beginning with the original transposon donor plasmid (977 bp), was progressively shortened or lengthened and integration efficiency with a three-plasmid expression system was maximal with a ~775-bp transposon and decayed with both the shorter and longer cargos tested (FIGS. 3C and 3H). Interestingly, naturally occurring Tn7-like transposons that encode CRISPR-Cas systems range from 20 to >100 kb, though their capacity for active mobility is unknown.

Both ends of the transposon were separately truncated and it was found that approximately 105 bp of the left end and approximately 47 bp of the right end were important for efficient RNA-guided DNA integration, corresponding to three and two intact putative TnsB binding sites, respectively (FIGS. 11A-11D). Shorter transposons containing right end truncations were integrated more efficiently, accompanied by a drastic change in the orientation bias.

Guide RNA and Target DNA Requirements

Figure 12A:
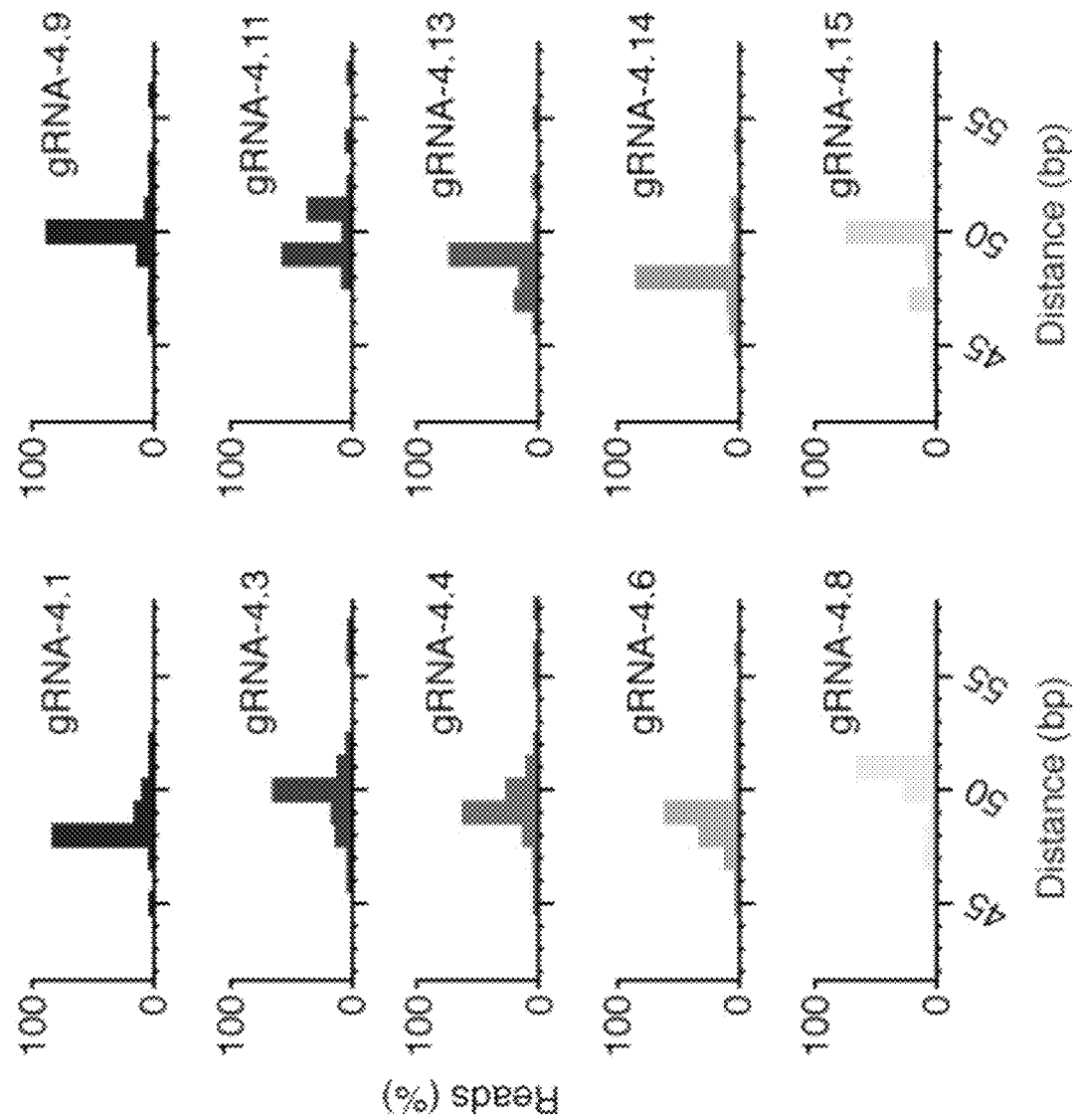

The Tn6677-encoded CRISPR-Cas system is most closely related to the I-F subtype, in which DNA target recognition by Cascade requires a consensus 5'-CC-3' PAM, a high degree of sequence complementarity within a PAM-proximal seed sequence, and additional base-pairing across the entire 32-bp protospacer. To determine sequence determinants of RNA-guided DNA targeting, 12 dinucleotide PAMs were tested by sliding the guide sequence in 1-bp increments along the lacZ gene relative to gRNA-4 (FIG. 3D). In total, 8 distinct dinucleotide PAMs supported transposition at levels that were >25% of the 5'-CC-3' PAM, and transposition occurred at >1% total efficiency across the entire set of PAMs tested (FIG. 3D). This efficiency was conserved when the dinucleotide PAM had the same sequence as the 3' end of the CRISPR repeat sequence. Although this so-called "self sequence" is typically excluded during PAM-dependent target search in canonical immune responses involving DNA interference or priming, DNA binding by Vch Cascade does not lead to Cas3 recruitment, which in well-studied type I CRISPR-Cas systems is PAM-sensitive. Additional deep sequencing revealed that the distance between the Cascade target site and primary transposon integration site remained at approximately 47-51 bp across the panel of gRNAs tested (FIGS. 3E and 12A). Nevertheless, these experiments highlight how PAM recognition plasticity can be harnessed to direct a high degree of insertion flexibility and specificity at base-pair resolution.

Figure 3F:
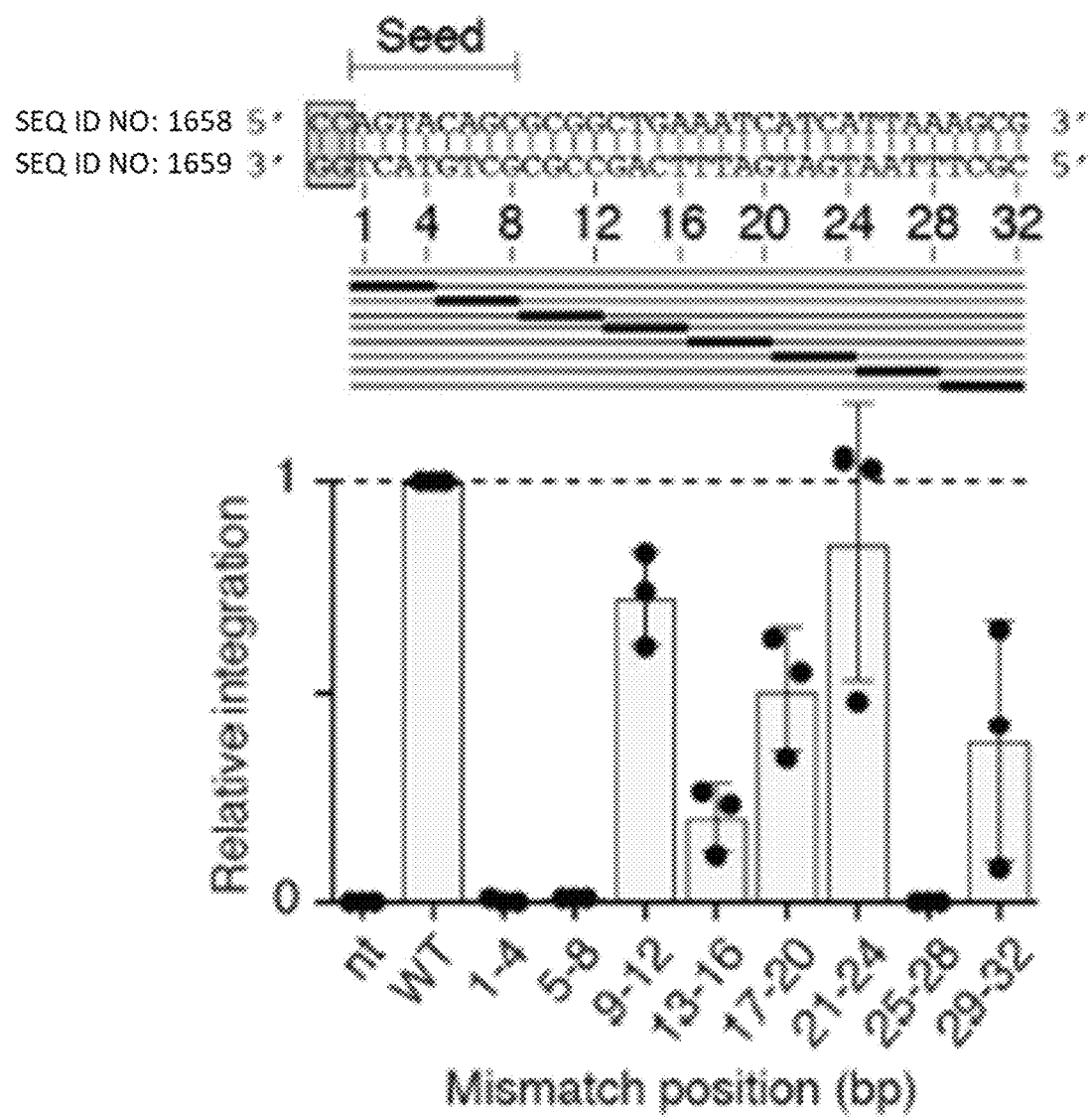
Figure 3G:
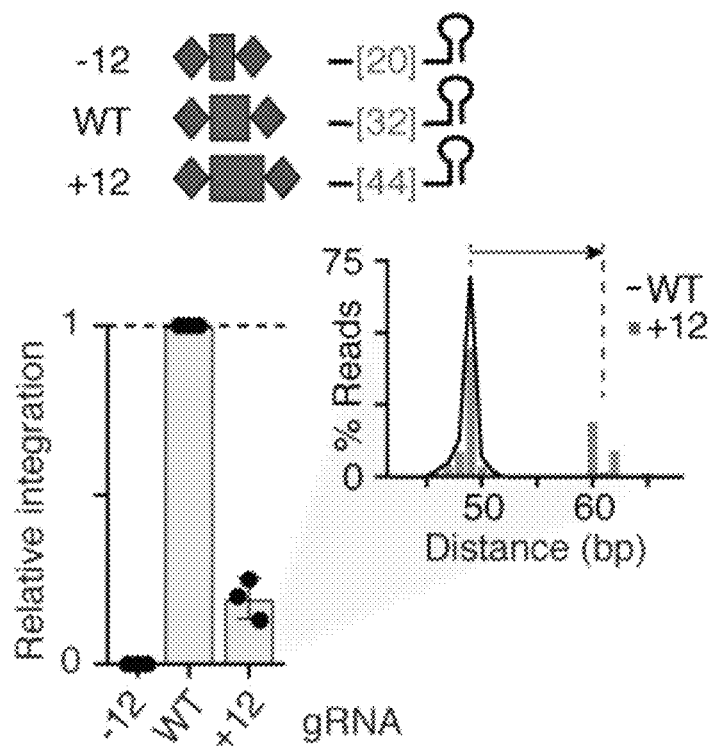
Figure 3H:
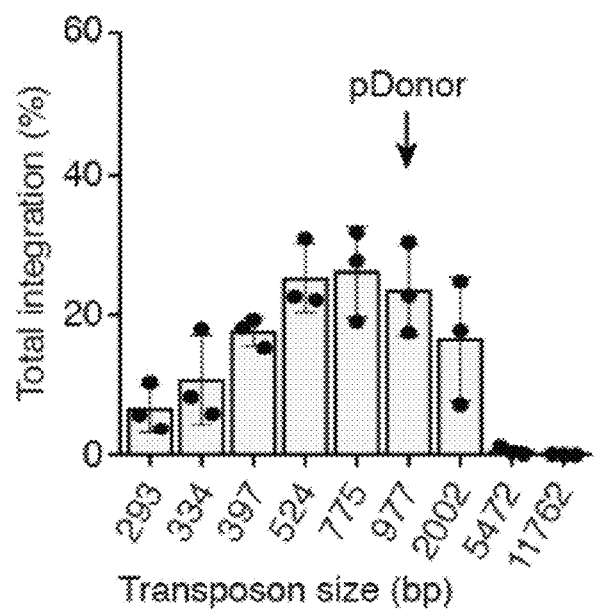
Figure 3I:
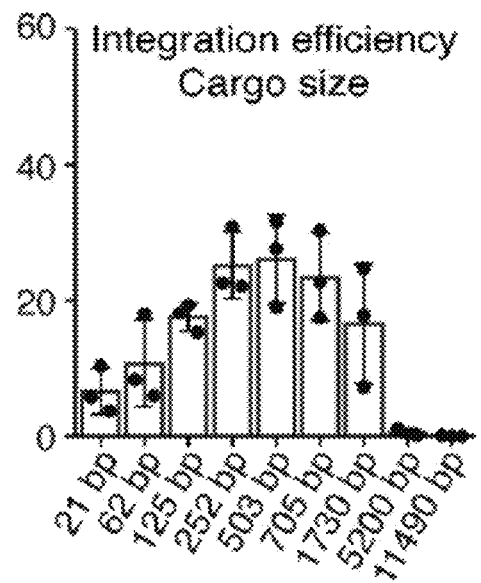
Figure 3J:
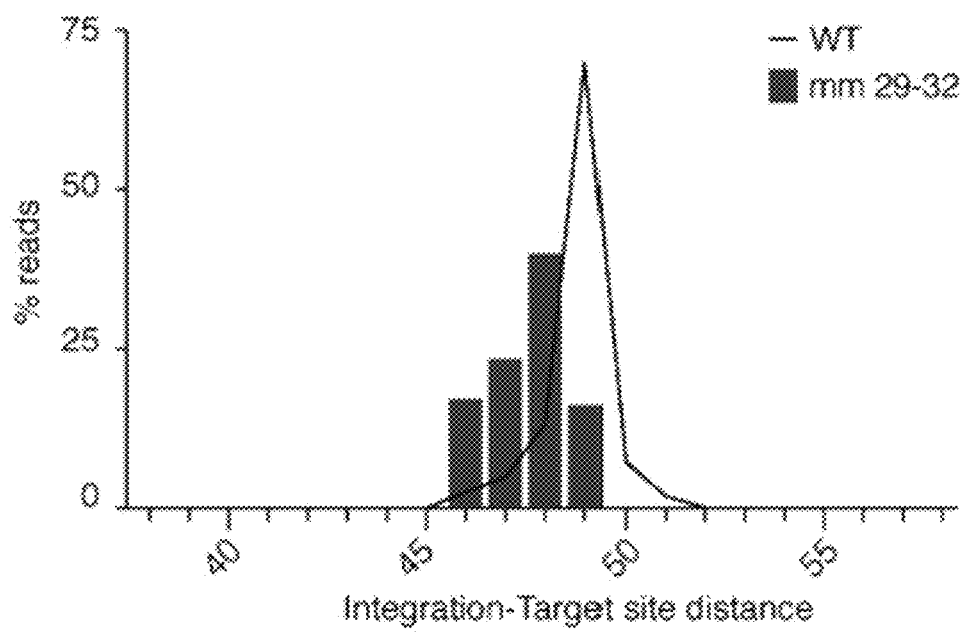

To probe the sensitivity of transposition to RNA-DNA mismatches, consecutive blocks of 4-nt mismatches along the guide portion of gRNA-4 were tested (FIGS. 3F and 3J). Mismatches within the 8-nt seed sequence severely reduced transposition, likely due to the inability to form a stable R-loop. Unexpectedly, though, the results highlighted a second region of mismatches at positions 25-29 that abrogated DNA integration, despite previous studies demonstrating that DNA binding stability is largely insensitive to mismatches in this region. For the terminal mismatch block, which retained 17% integration activity, the distribution of observed integration sites was markedly skewed to shorter distances from the target site relative to gRNA-4 (FIG. 12B), which may be the result of R-loop conformational heterogeneity.

The model for RNA-guided DNA integration involves Cascade-mediated recruitment of TniQ to target DNA. Prior work with *E. coli* Cascade has demonstrated that gRNAs with extended spacers form complexes containing additional Cas7 subunits, which would increase the distance between the PAM-bound Cas8 and Cas6 at the other end of the R-loop. Modified gRNAs containing spacers that were either shortened or lengthened in 6-nt increments from the 3' end were cloned and tested. gRNAs with truncated spacers showed little or no activity, whereas extended spacers facilitated targeted integration, albeit at reduced levels with increasing length (FIGS. 12C and 12D). The +12-nt gRNA directed transposition to two distinct regions: one ~49-bp from the 3' end of the wild-type 32-nt spacer, and an additional region shifted 11-13 bp away, in agreement with the expected increase in the length of the R-loop measured from the PAM (FIGS. 3G and 3K). These data, together with the mismatch panel, provide evidence that TniQ is tethered to the PAM-distal end of the R-loop structure.

Programmability and Genome-Wide Specificity

Figure 4A:
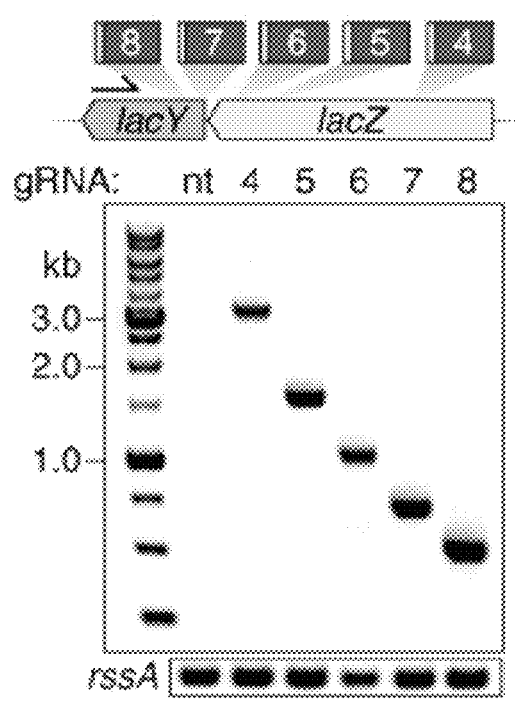
FIGS. 4A-4G are the genome-wide analysis of programmable RNA-guided DNA integration.

A series of gRNAs targeting additional genomic sites flanked by 5'-CC-3' PAMs within the lac operon were cloned and tested. Using the same primer pair for each resulting cellular lysate, it was shown by PCR that transposition was predictably repositioned with each distinct gRNA (FIG. 4A).

Figure 4B:
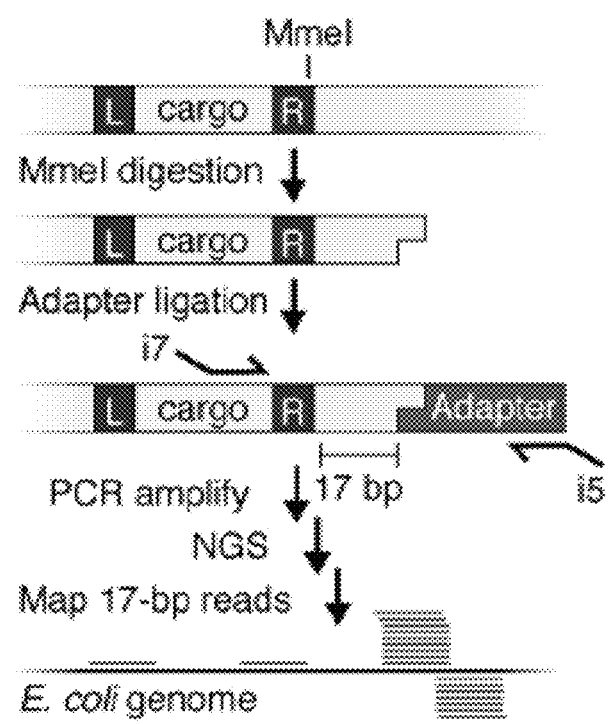
Figure 13A:
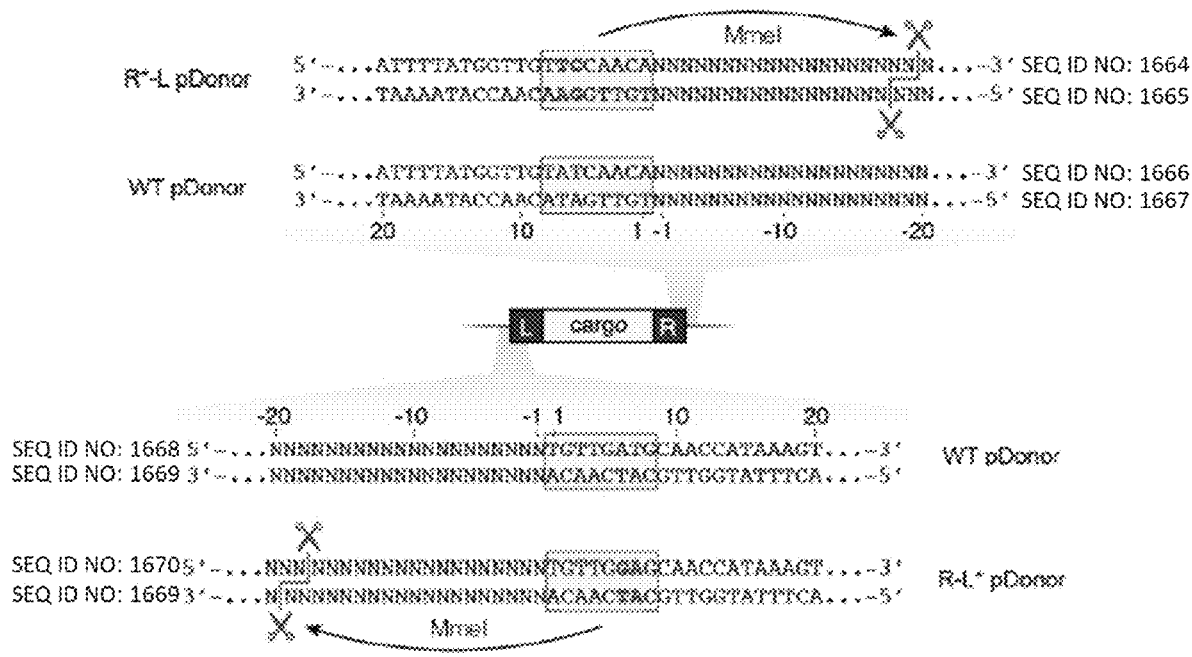
Figure 13B:
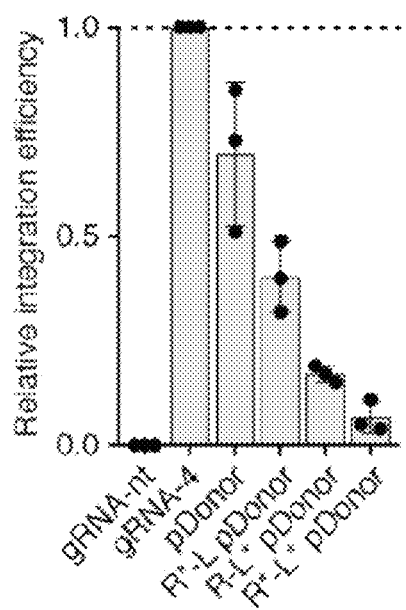
Figure 13C:
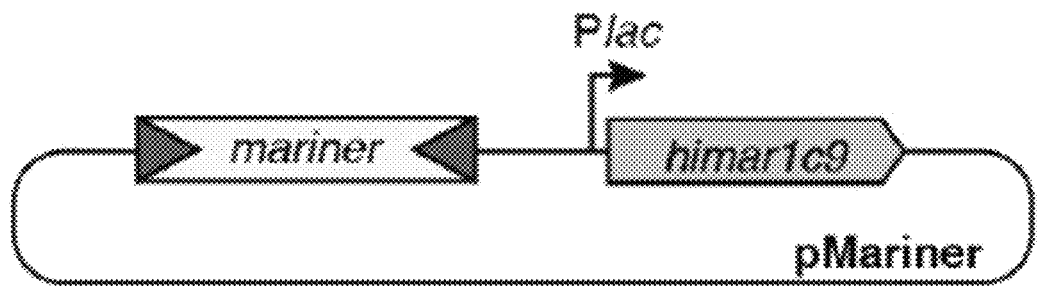
Figure 13D:
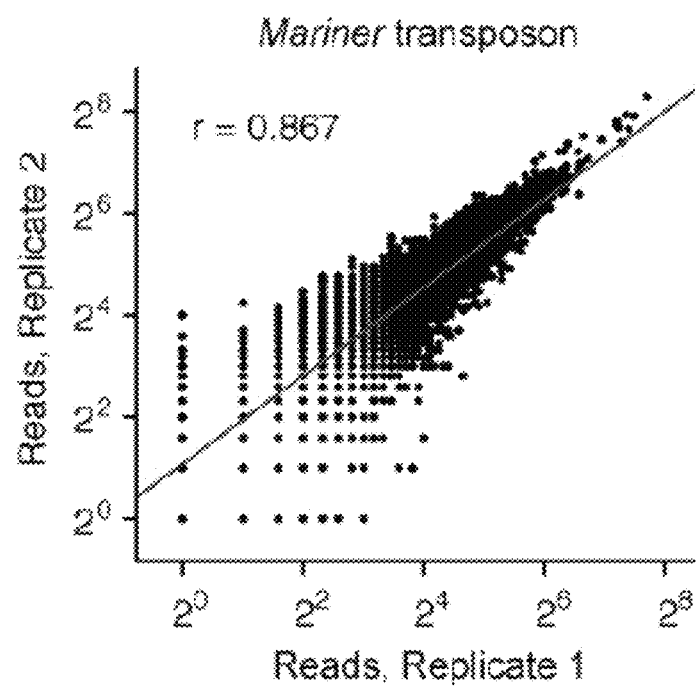
Figure 13H:
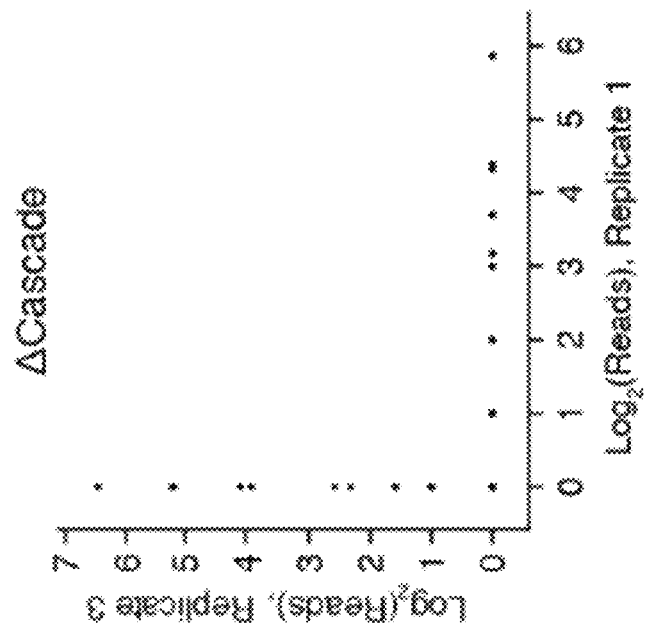
Figure 13G:
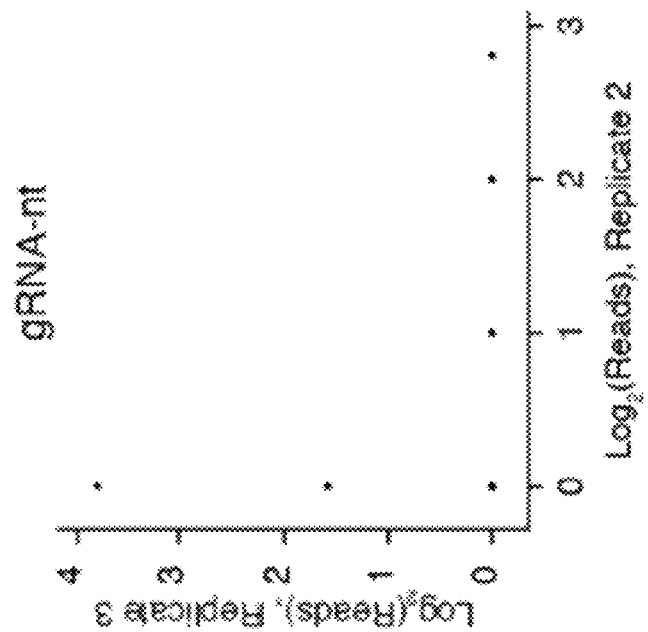

To test whether there was non-specific integration simultaneously occurring elsewhere, either at off-target genomic sites bound by Cascade, or independent of Cascade targeting, a transposon insertion sequencing (Tn-seq) pipeline previously developed for mariner transposons, in which all integration sites genome-wide are revealed by NGS, was adopted (FIGS. 4B and 13A-13B). Tn-seq was applied to a plasmid-encoded mariner transposon and the pipeline successfully recapitulated the genome-wide integration landscape previously observed with the Himar1c9 transposase (FIGS. 4C, 4D, 13C and 13D).

Figure 4C:
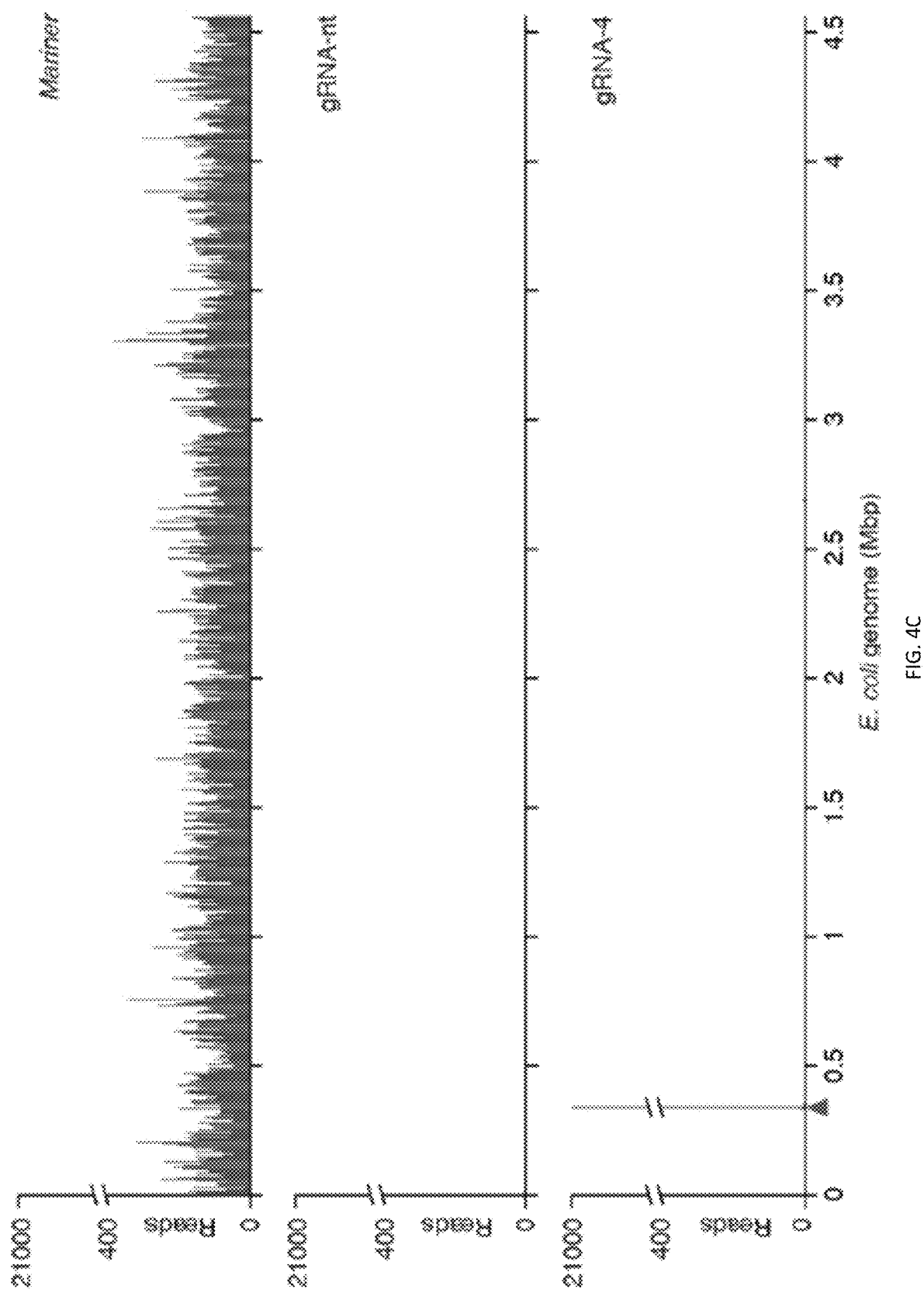
Figure 4F:
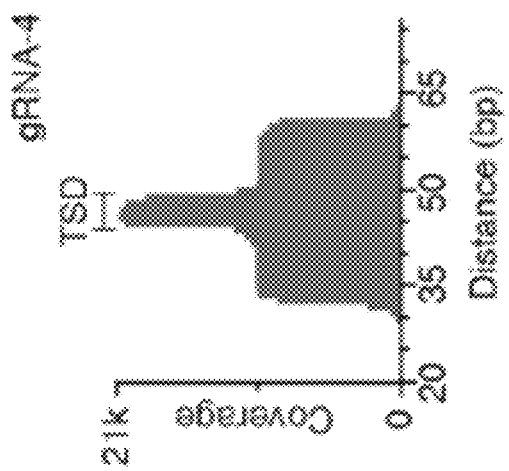
Figure 4E:
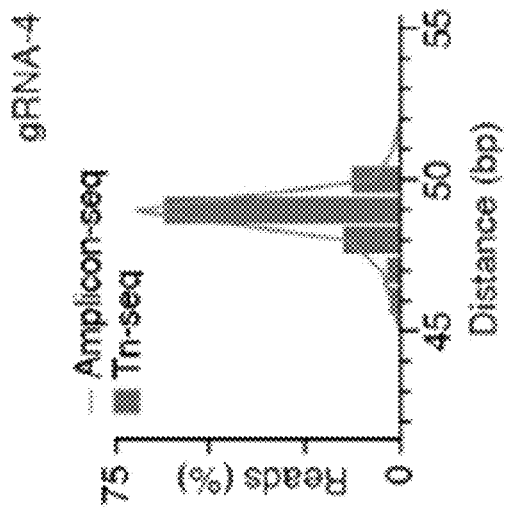
Figure 4D:
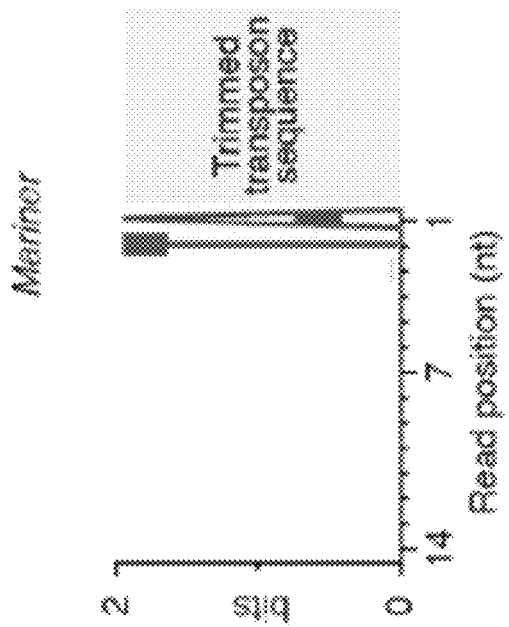
Figure 4G:
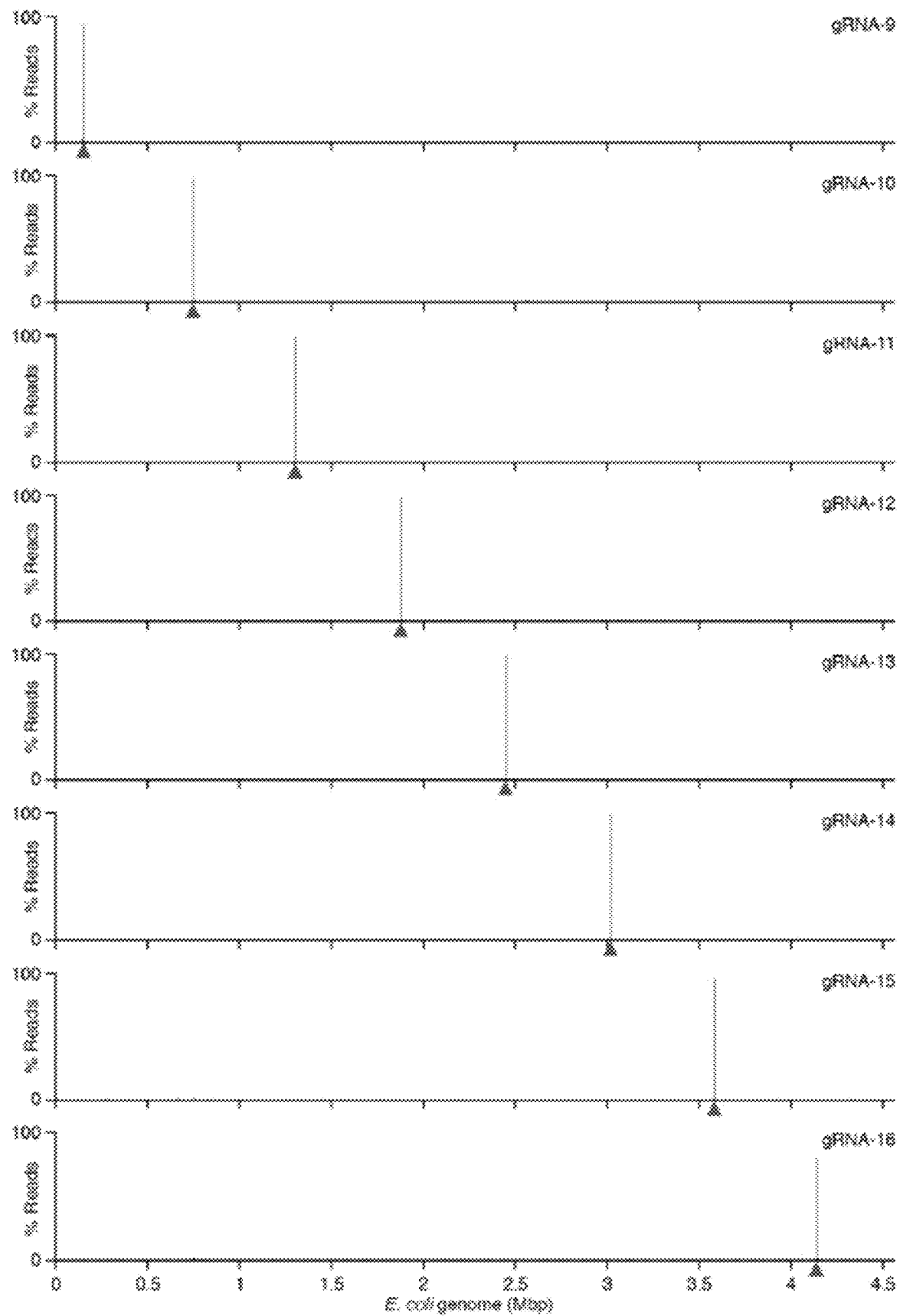

The same analysis was performed for the RNA-guided *V. cholerae* transposon programmed with gRNA-4, and exquisite selectivity for lacZ-specific DNA integration was observed (FIG. 4C). The observed integration site, which accounted for 99.0% of all Tn-seq reads that passed the filtering criteria, precisely matched the site observed by prior PCR amplicon NGS analysis (FIG. 4E), and no off-target integration events were reproducibly observed elsewhere in the genome across three biological replicates (FIGS. 13E and 13F). Tn-seq data yielded diagnostic read pileups that highlighted the 5-bp TSD and corroborated the previous measurements of transposon insertion orientation bias discussed above (FIG. 4F). Tn-seq libraries from *E. coli* strains harboring pQCascade programmed with the non-targeting gRNA-nt, or from strains lacking Cascade altogether (but still containing pDonor and pTnsABCQ), yielded far fewer genome-mapping reads, and no integration sites were consistently observed across multiple biological replicates (FIGS. 4C and 13G-13I).

Figure 14A:
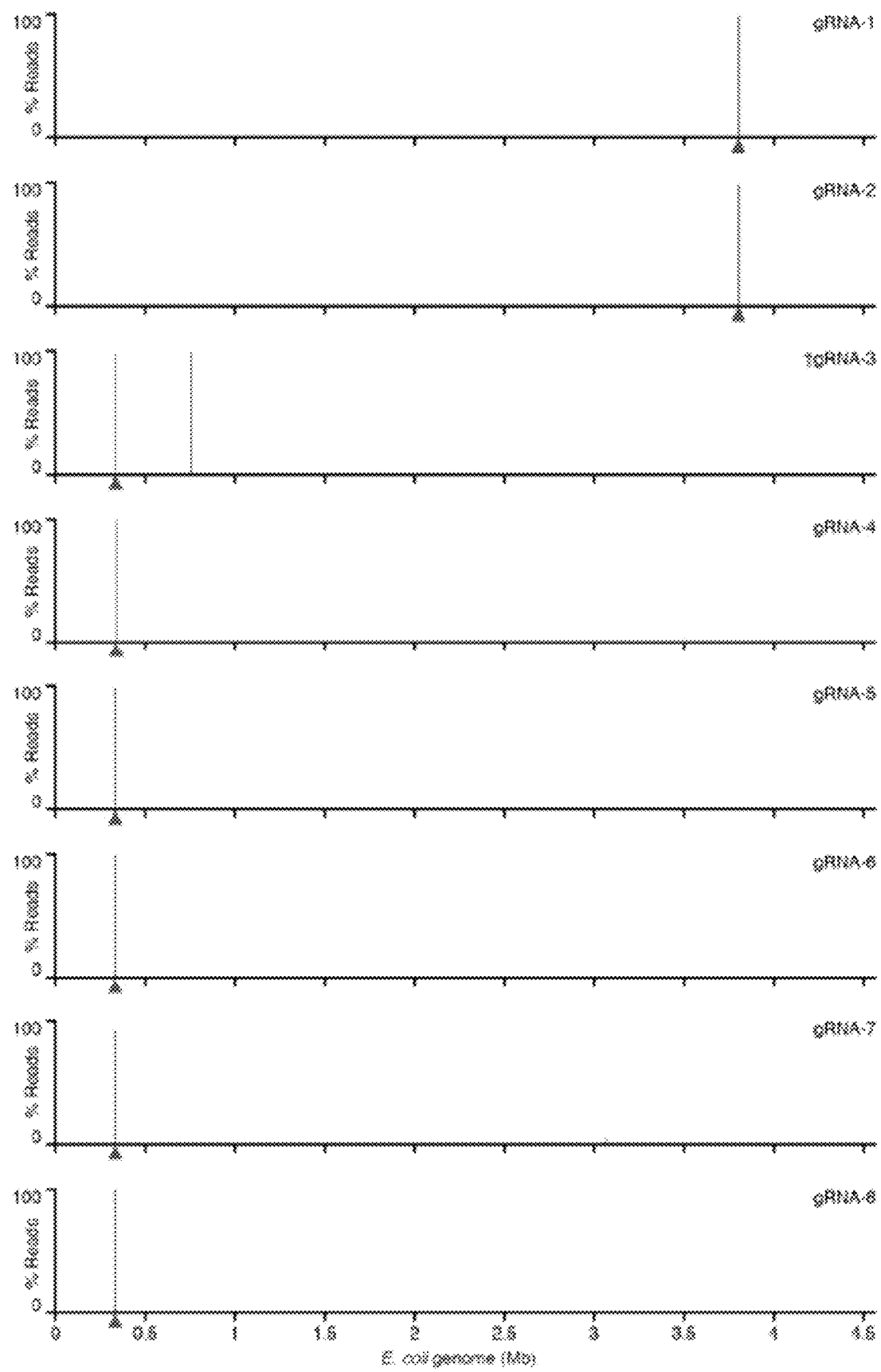
FIGS. 14A-14E are the Tn-seq data for additional gRNAs tested.
Figure 14B:
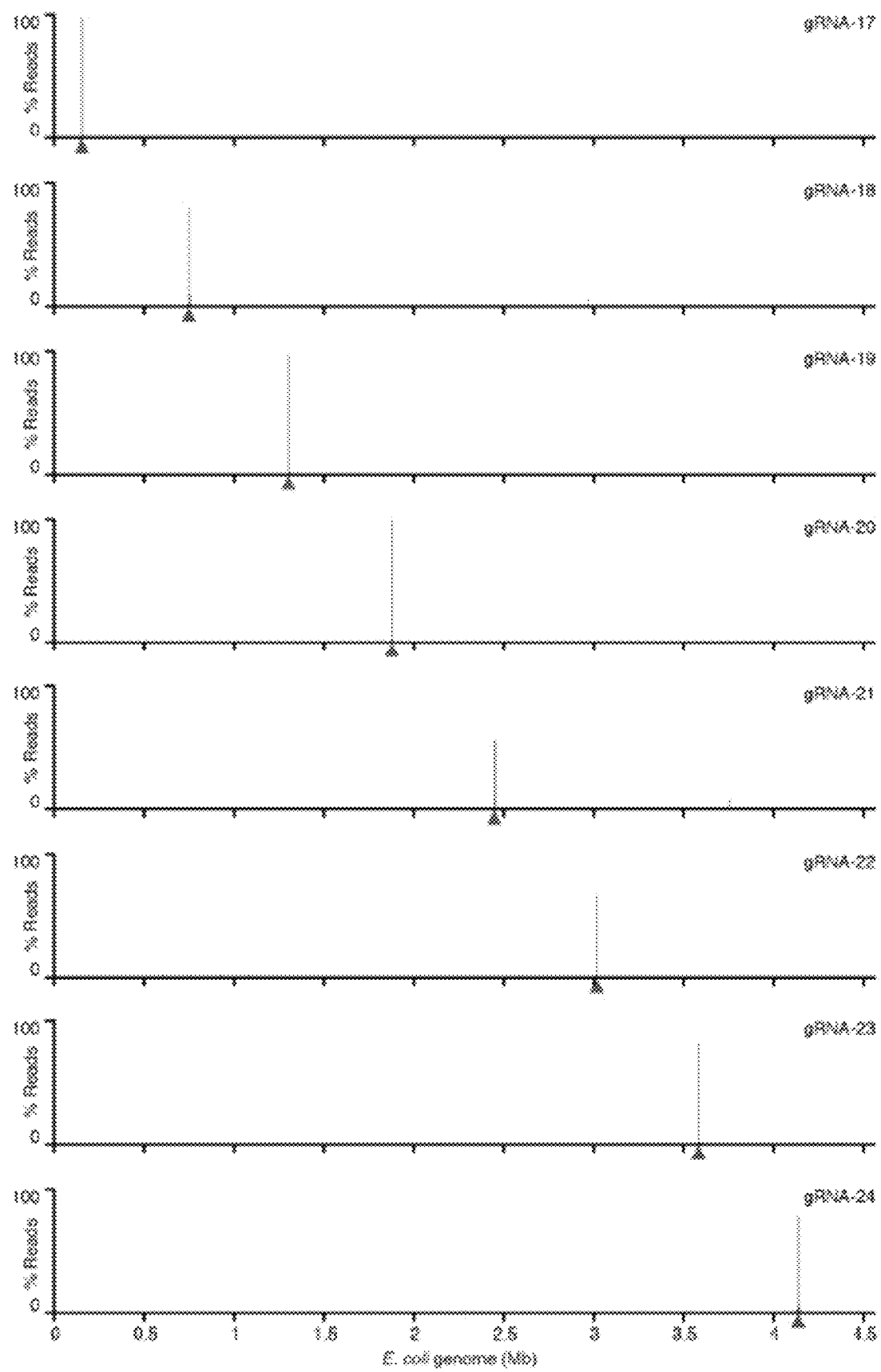
Figure 14C:
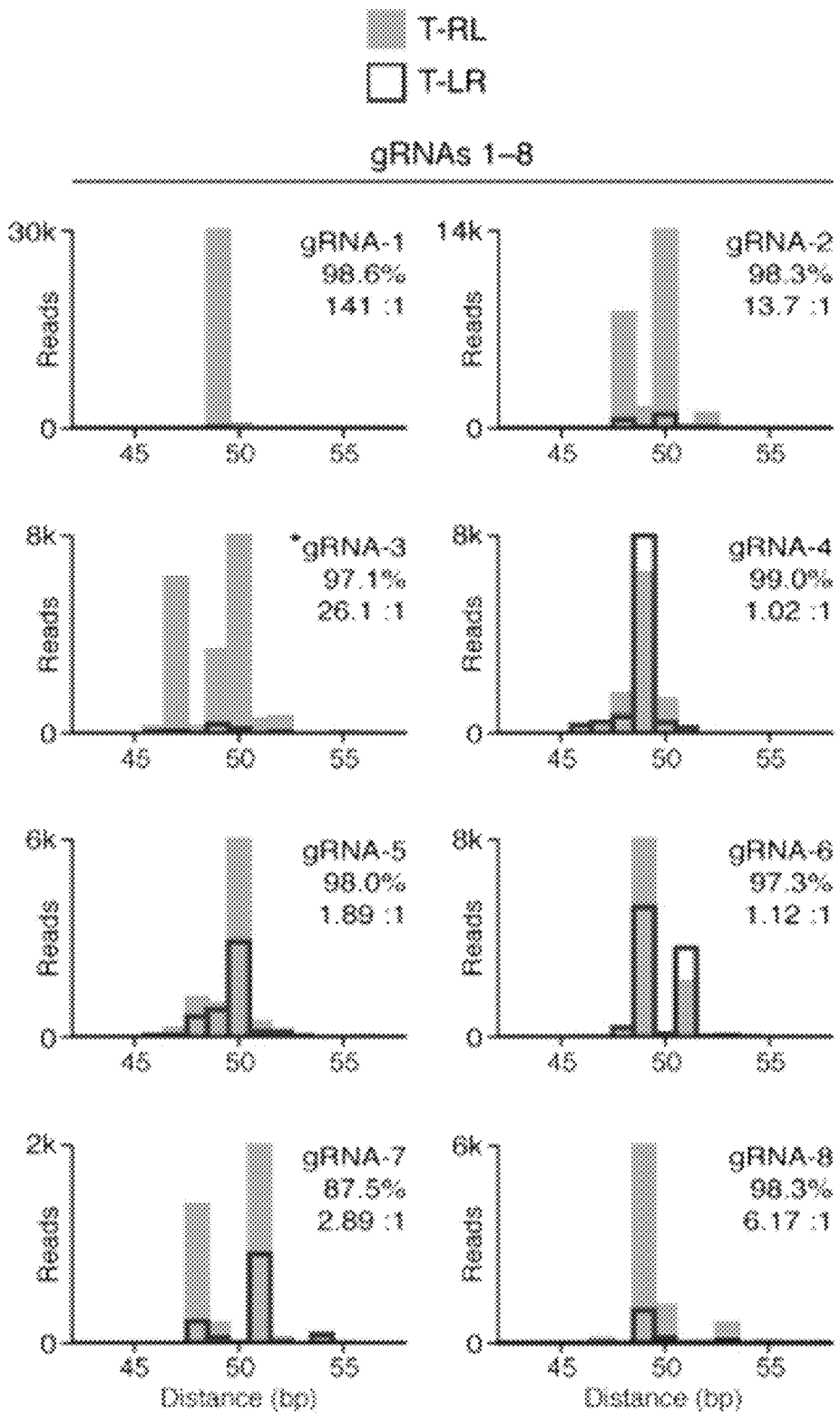
Figure 14D:
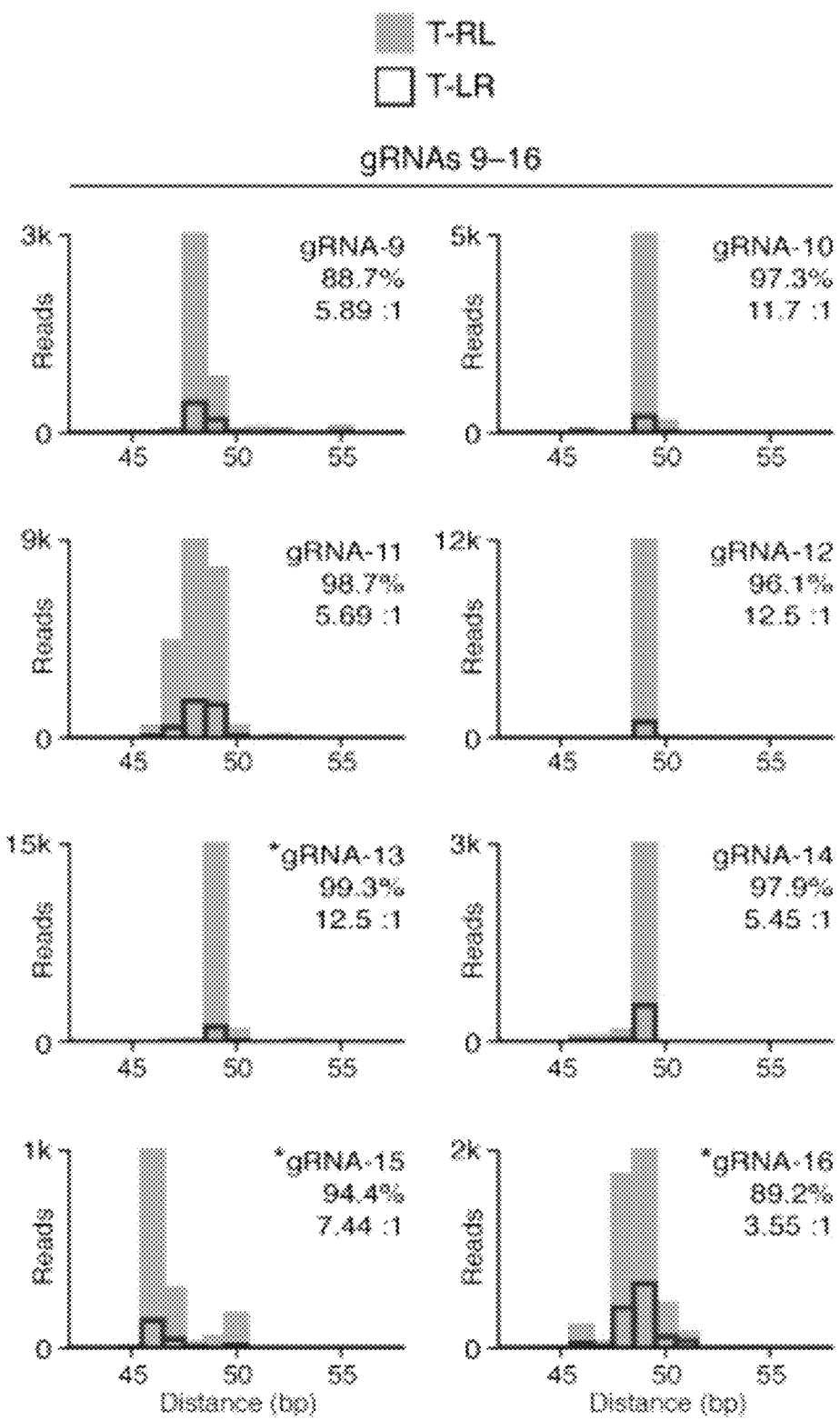
Figure 14E:
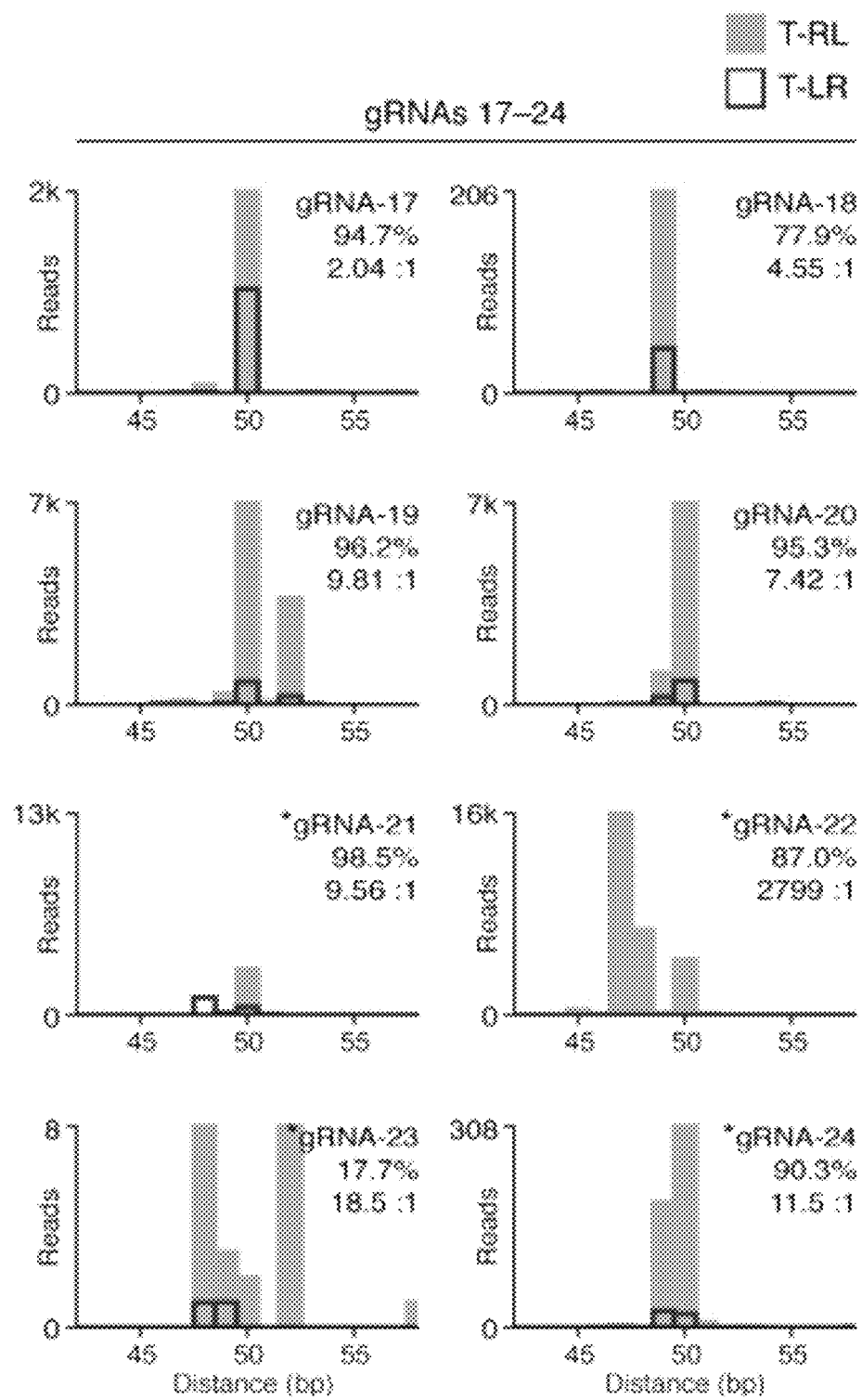

In addition to performing Tn-seq with the gRNAs targeting glmS and lacZ genomic loci (FIG. 14A), an additional 16 gRNAs targeting the *E. coli* genome at 8 arbitrary locations spaced equidistantly around the circular chromosome were cloned and tested. Beyond requiring that target sites were unique, flanked by a 5'-CC-3' PAM, and located within intergenic regions, no further design rules or empirical selection criteria were applied. When the resulting Tn-seq data was analyzed, 16/16 gRNAs directed highly precise RNA-guided DNA integration 46-55 bp downstream of the Cascade target, with ~95% of all filtered Tn-seq reads mapping to the primary integration site (FIGS. 4G and 14B-E). These experiments highlight the high degree of intrinsic programmability and genome-wide integration specificity directed by transposon-encoded CRISPR-Cas systems.

Figure 5A:
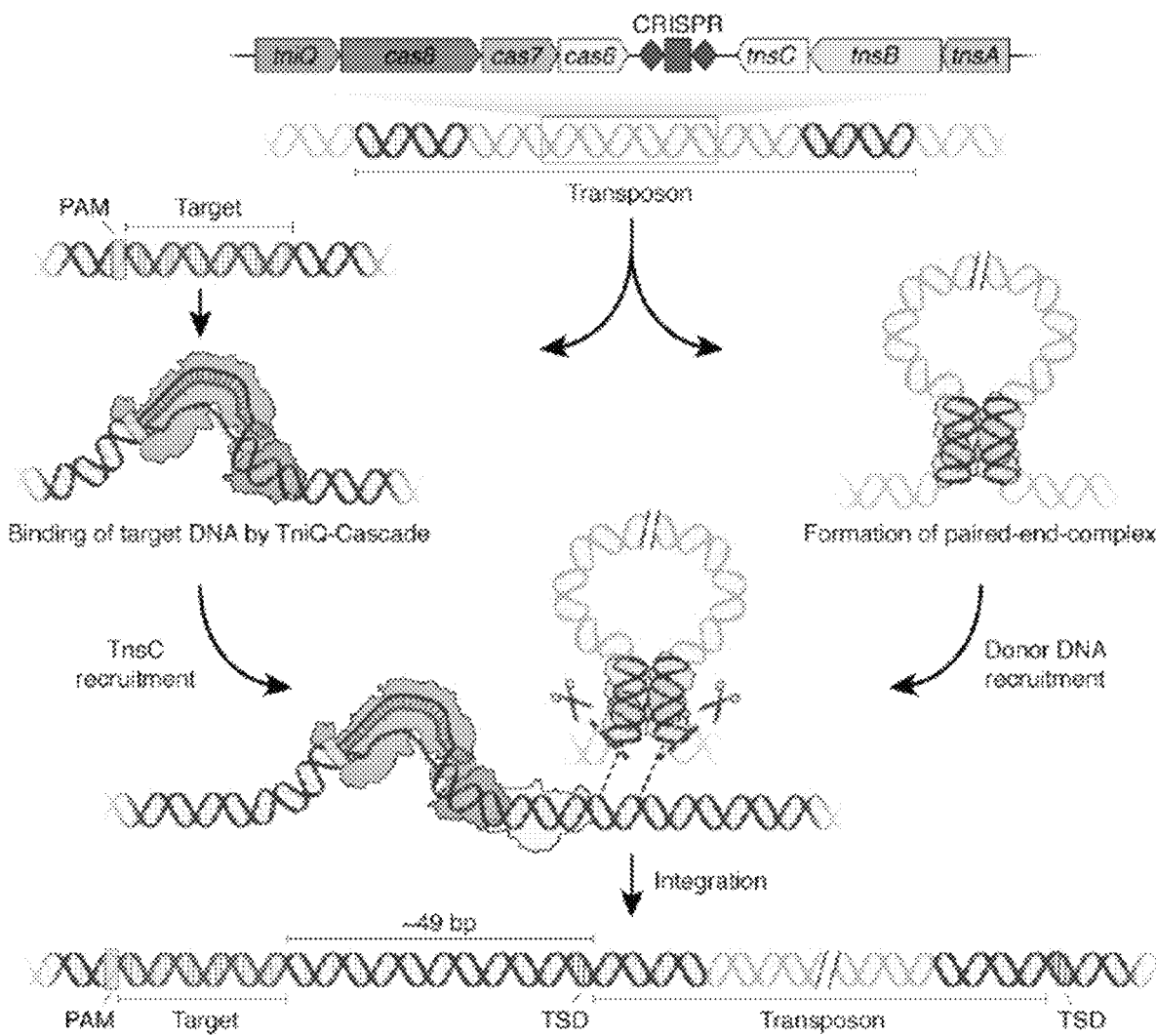
FIGS. 5A-5B are proposed models for RNA-guided DNA integration by Tn7-like transposons encoding CRISPR-Cas systems. The *V. cholerae* Tn6677 transposon encodes a programmable RNA-guided DNA-binding complex called Cascade, which forms a novel co-complex with TniQ. TniQ-Cascade complexes surveil the cell for matching DNA target sites, which may be found on the host chromosome or mobile genetic elements. Upon target binding and R-loop formation, DNA-bound TniQ recruits the non-sequence-specific DNA-binding protein, TnsC, based on previous studies of *E. coli* Tn7 likely leading to eventual formation of a large, megadalton-sized structure known as the transposome, which comprises the TniQ-Cascade-bound target DNA, TnsC, and the TnsAB-bound transposon donor DNA. The transposon itself is bound at the left and right ends by TnsA and TnsB, forming a so-called paired-end complex that is recruited to the target DNA by TnsC. Excision of the transposon from its donor site allows for targeted integration at a fixed distance downstream of DNA-bound TniQ-Cascade, resulting in a 5-bp target site duplication.
Figure 5B:
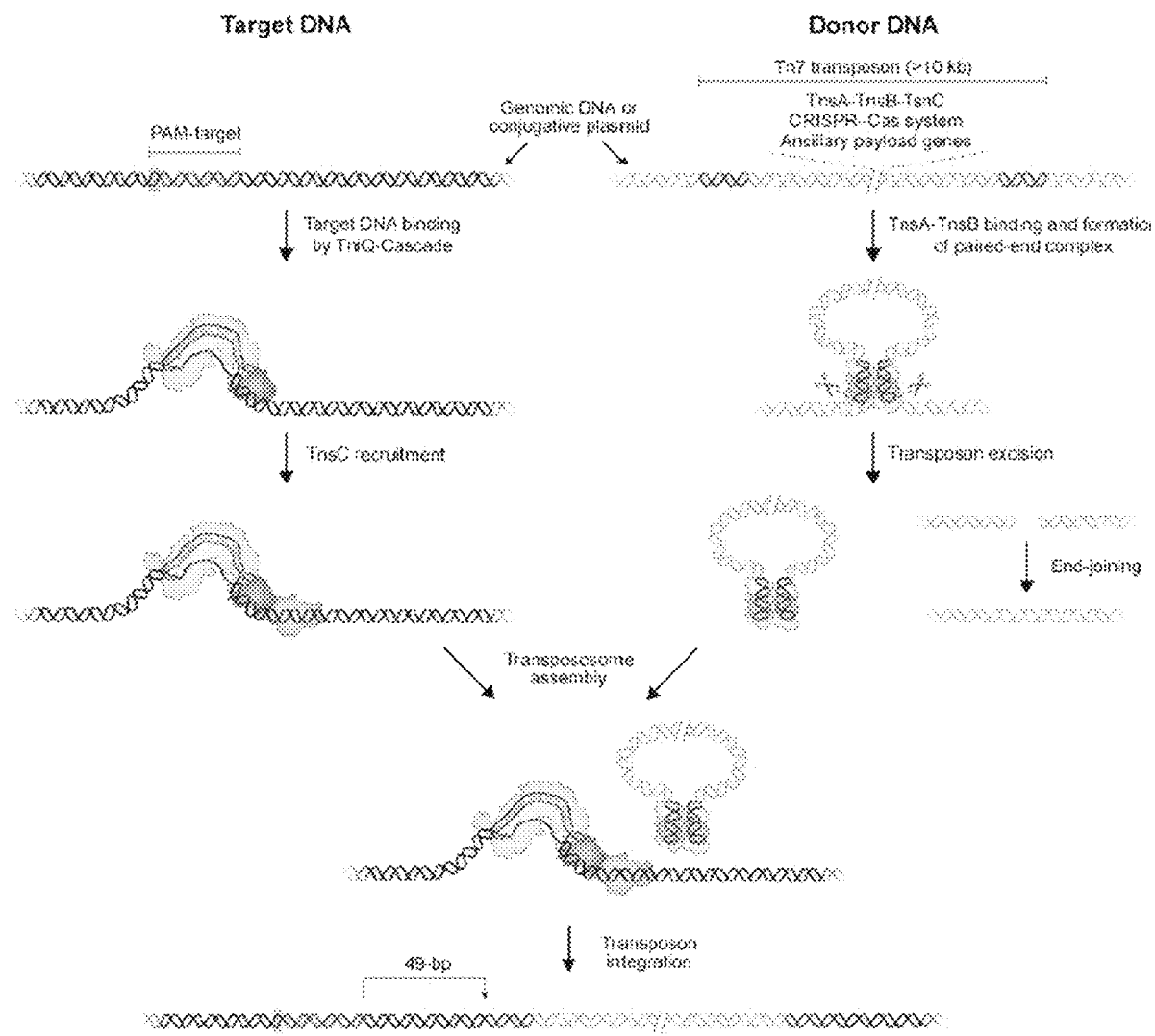

Transposases and integrases are generally thought to mobilize their specific genetic payloads by integrating either randomly, with a low degree of sequence specificity, or by targeting specialized genomic loci through inflexible, sequence-specific homing mechanisms. A fully programmable integrase was found in which the DNA insertion activity of a heteromeric transposase from *Vibrio cholerae* is directed by an RNA-guided complex called Cascade, whose DNA targeting specificity can be easily tuned. Beyond defining fundamental parameters governing this activity, a novel complex between Cascade and TniQ that mechanistically connects the transposon- and CRISPR-associated machineries was also found. Based on the above results, and on previous studies of Tn7 transposition, proposed models for the RNA-guided mobilization of Tn7-like transposons encoding CRISPR-Cas systems (using the Type I-F variant as an Example) are shown in FIGS. 5A and 5B.

Many biotechnology products require genomic integration of large genetic payloads, including gene therapies, engineered crops, and biologics, and the advent of CRISPR-based genome editing has increased the need for effective knock-in methods. Yet current genome engineering solutions are limited by a lack of specificity, as with randomly-integrating transposases, and non-homologous end joining approaches, or by a lack of efficiency and cell type versatility, as with homology-directed repair. The ability to insert transposable elements by guide RNA-assisted targeting (INTEGRATE) provides for site-specific DNA integration that obviates the need for double-strand breaks in the target DNA, homology arms in the donor DNA, and host DNA repair factors. By virtue of its facile programmability, this technology finds use for multiplexing and large-scale screening using guide RNA libraries.

Materials and Methods

Plasmid Construction.

All plasmids used in this study are SEQ ID NOs: 1-139, disclosed in SEQ ID NOs: 1-139, and a subset are available on Addgene. Briefly, genes encoding *V. cholerae* strain HE-45 TnsA-TnsB-TnsC and TniQ-Cas8-Cas7-Cas6 (SEQ ID NOs: 141, 143, 145, 147, 149, 151, and 153) were synthesized by GenScript and cloned into pCOLADuet-1 and pCDFDuet-1, respectively, yielding pTnsABC and pQCascadeACRISPR. A pQCascade entry vector (pQCascade_entry) was generated by inserting tandem BsaI restriction sites flanked by two CRISPR repeats downstream of the first T7 promoter, and specific spacers (FIG. 10O) were subsequently cloned by oligoduplex ligation, yielding pQCascade. To generate pDonor, a gene fragment (GenScript) encoding both transposon ends was cloned into pUC19, and a chloramphenicol resistance gene was subsequently inserted within the transposon. Further derivatives of these plasmids were cloned using a combination of methods, including Gibson assembly, restriction digestion-ligation, ligation of hybridized oligonucleotides, and around-the-horn PCR. Plasmids were cloned and propagated in NEB Turbo cells (NEB), purified using Miniprep Kits (Qiagen), and verified by Sanger sequencing (GENEWIZ).

For transposition experiments involving the *E. coli* Tn7 transposon, pEcoDonor was generated similarly to pDonor, and pEcoTnsABCD was subcloned from pCW4 (Addgene plasmid #8484). Briefly, *E. coli* tnsA-tnsB-tnsC-tnsD operon was cloned into pCOLADuet-1 downstream of a T7 promoter, generating pEcoTnsABCD, and an *E. coli* transposon donor construct into pUC19, generating pEcoDonor. For transposition and cell killing experiments involving the I-F system from *P. aeruginosa*, genes encoding Cas8-Cas5-Cas7-Cas6 (also known as Csy1-Csy2-Csy3-Csy4) were subcloned from pBW64, and the gene encoding the natural Cas2/3 fusion protein was subcloned from pCas1_Cas2/3 (Addgene plasmid #89240). For transposition and cell killing experiments involving the II-A system from *S. pyogenes*, the gene encoding Cas9 was subcloned from a vector in-house. For control Tn-seq experiments using the mariner transposon and Himar1C9 transposase, the relevant portions were subcloned from pSAMEc (Addgene plasmid #102939).

Expression plasmids for protein purification were subcloned from pQCascade into p2CT-10 (Addgene plasmid #55209), and the gRNA expression construct was cloned into pACYCDuet-1.

Figure 15:
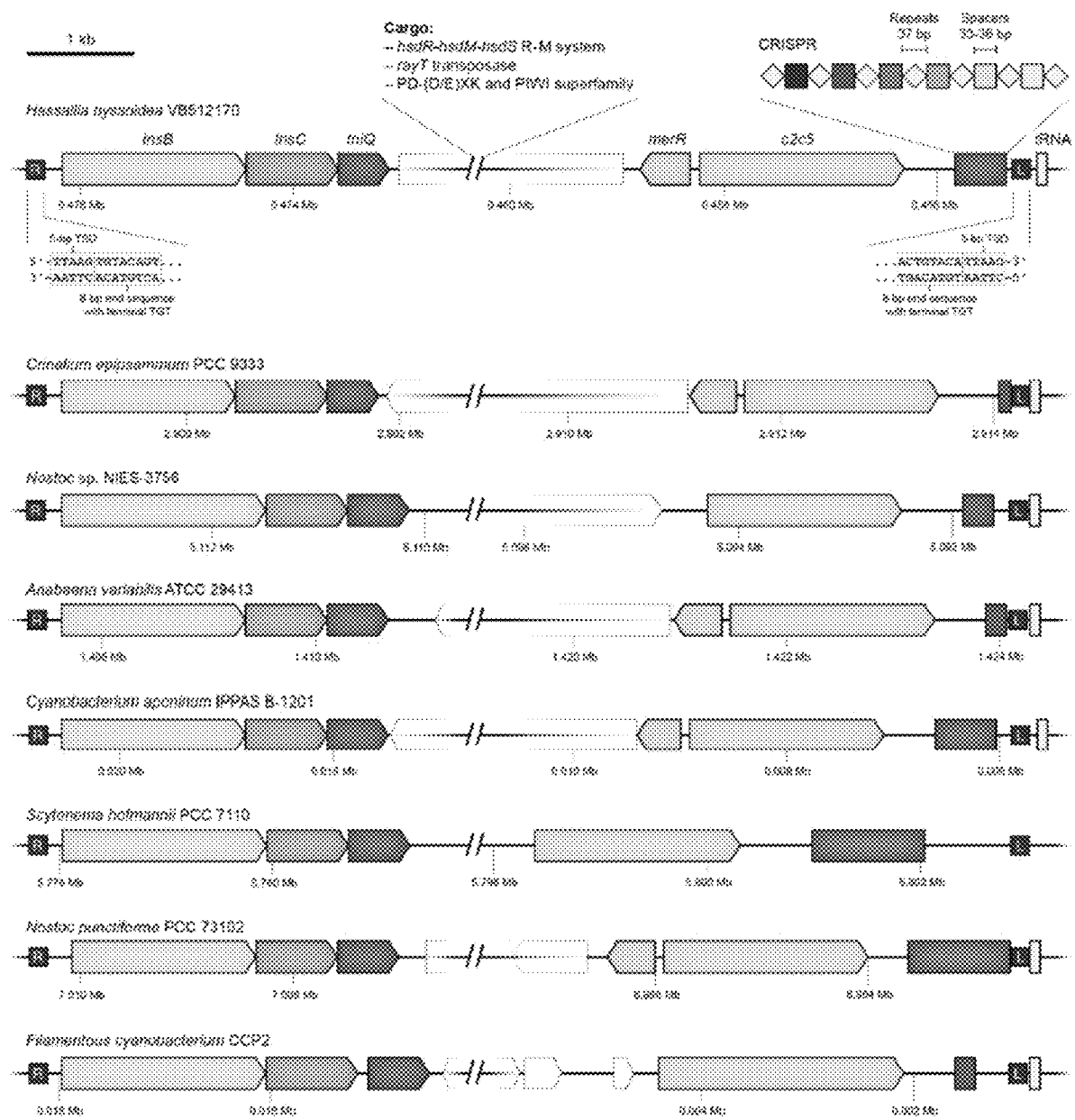
FIG. 15 shows that bacterial transposons also harbor Type V-U5 CRISPR-Cas systems encoding C2c5. Representative genomic loci from various bacterial species containing identifiable transposon ends (blue boxes, L and R), genes with homology to tnsB-tnsC-tniQ (shades of yellow), CRISPR arrays (maroon), and the CRISPR-associated gene c2c5 (blue). The example from *H. byssoidea* (top) highlights the target site duplication and terminal repeats, as well as genes found within the cargo portion of the transposon. As with Type I CRISPR-Cas system-containing Tn7-like transposons, Type V CRISPR-Cas system-containing transposons seem to preferentially harbor genes associated with innate immune system functions, such as restriction-modification systems. C2c5 genes are frequently flanked by the predicted transcriptional regulator, merR (light blue), and the C2c5-containing transposons appear to usually fall just upstream of tRNA genes (green), a phenomenon that has also been observed for other prokaryotic integrative elements. Analysis of 50 spacers from the eight CRISPR arrays shown with CRISPRTarget revealed 6 spacers with imperfectly matching targets (average of 6 mismatches), none of which mapped to bacteriophages, plasmids, or to the same bacterial genome harboring the transposon itself.
Figure 16A:
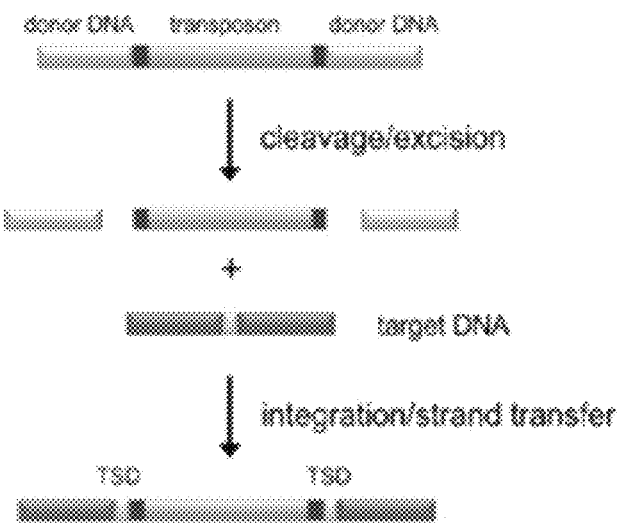
FIGS. 16A-16B are exemplary schematics of transposition via cut-and-paste versus copy-and-paste mechanisms.
Figure 16B:
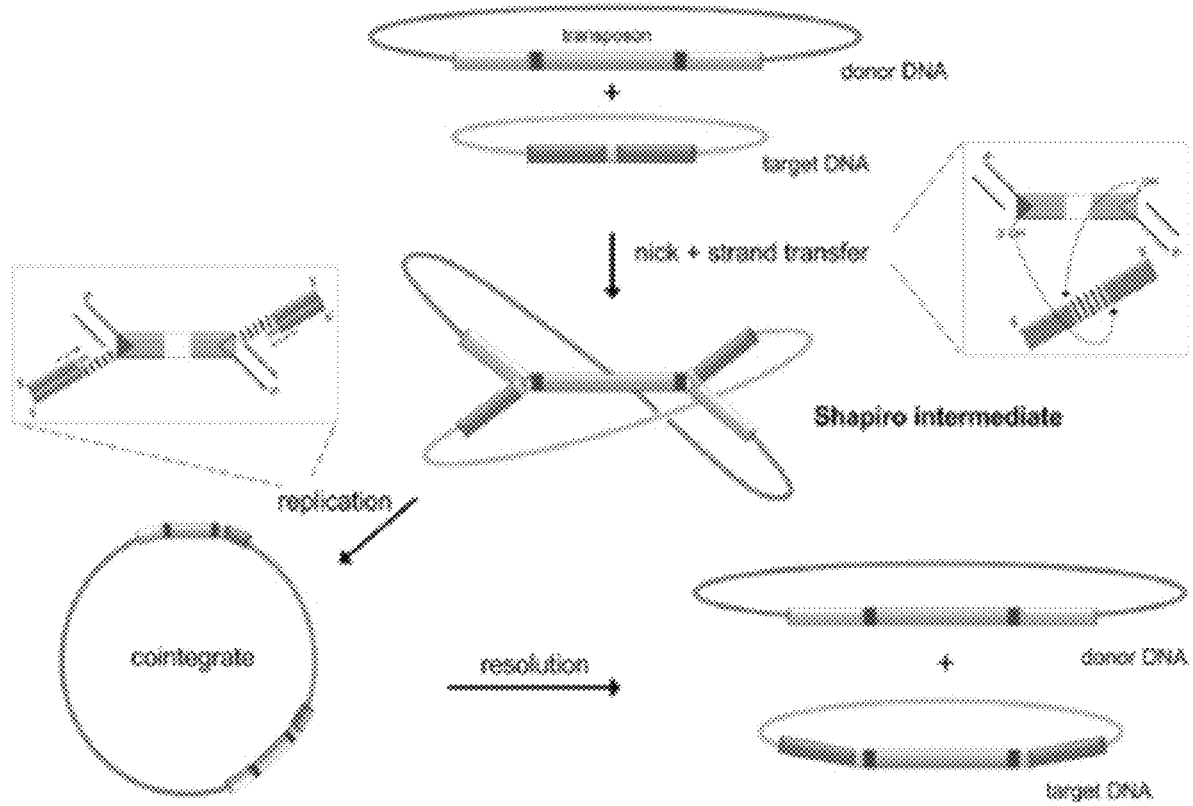
Figure 17A:
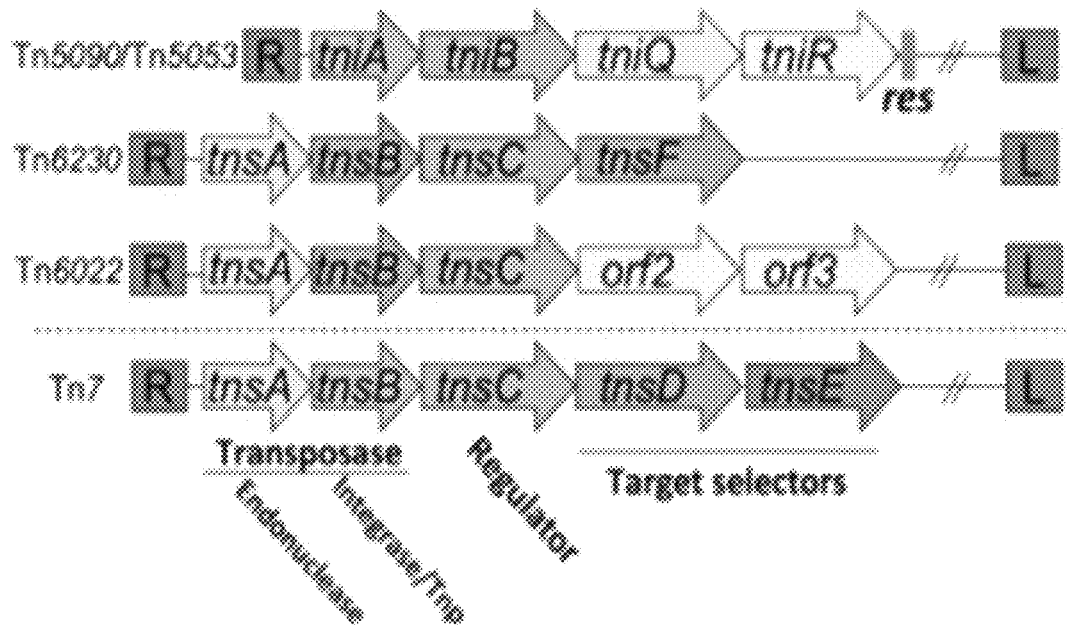
FIGS. 17A-17C show the comparison of transposition genes in transposons that harbor Type I-F and Type V CRISPR-Cas systems.
Figure 17B:
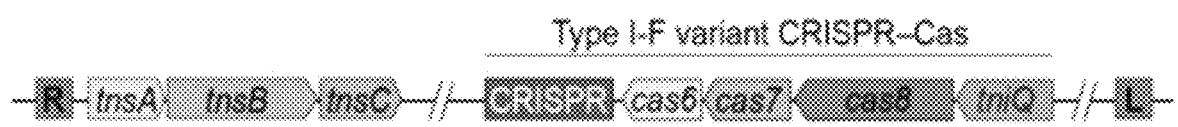
Figure 17C:
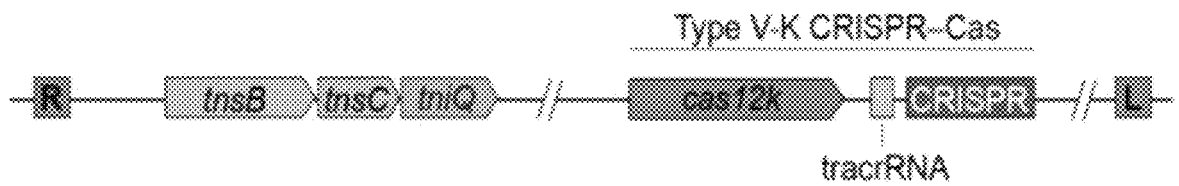

Multiple sequence alignments were performed using Clustal Omega with default parameters and visualized with ESPript 3.0. Analysis of spacers from C2c5 CRISPR arrays (FIG. 15) were performed using CRISPRTarget.

Transposition Experiments.

Figure 10A:
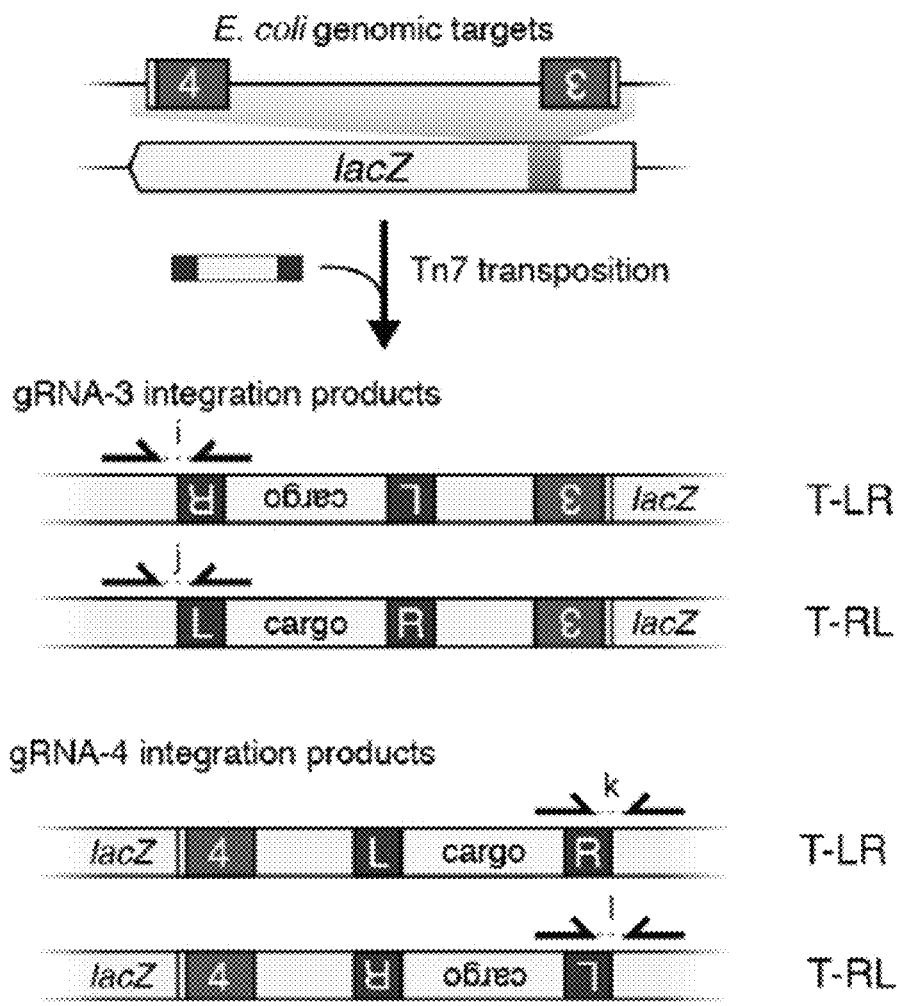
FIGS. 10A-10E are qPCR-based quantifications of RNA-guided DNA integration efficiencies.
Figure 10B:
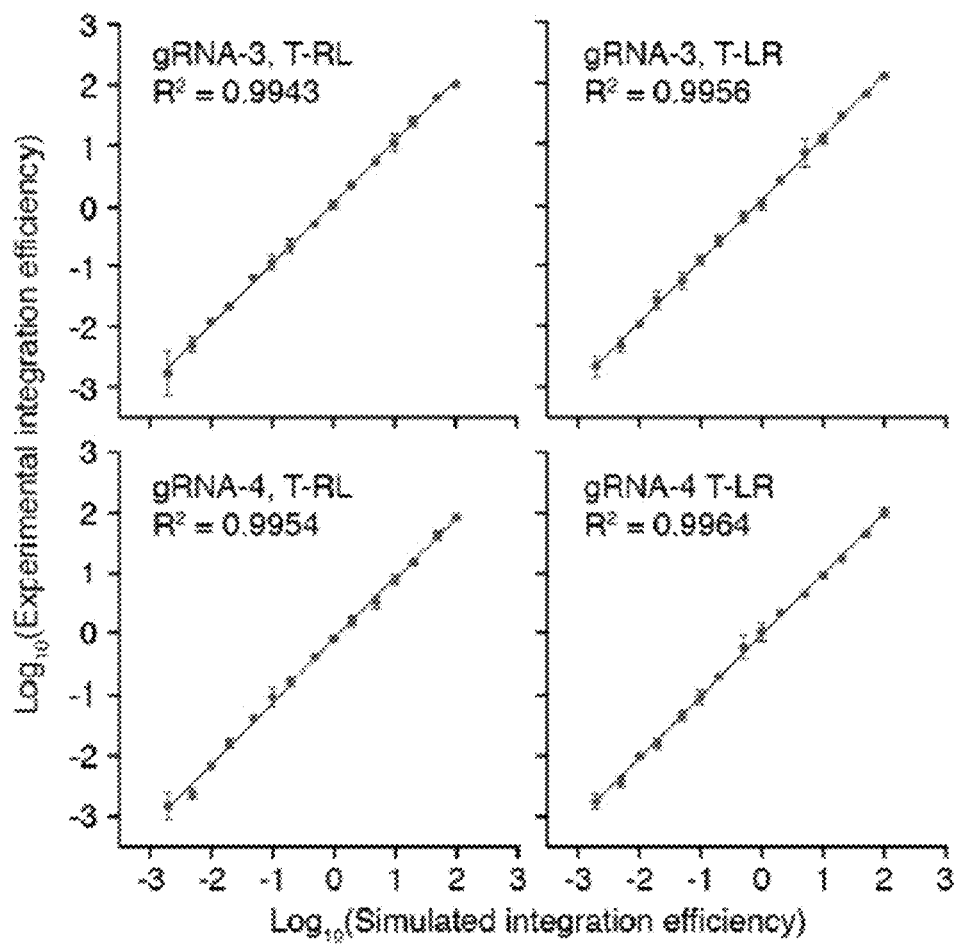
Figure 10C:
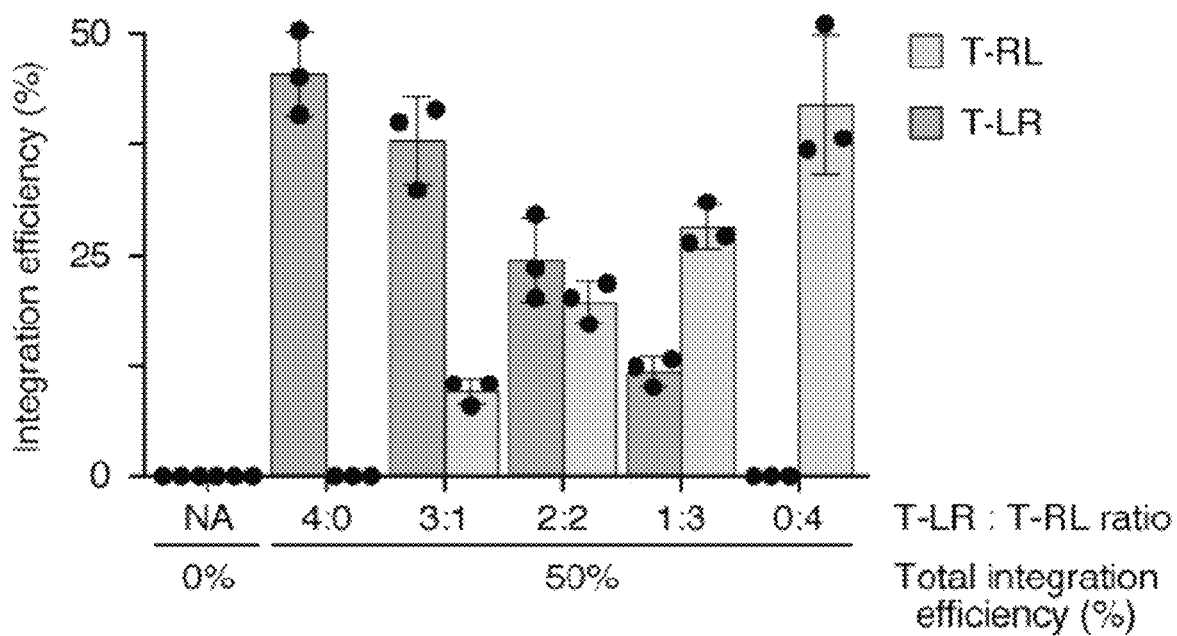
Figure 10D:
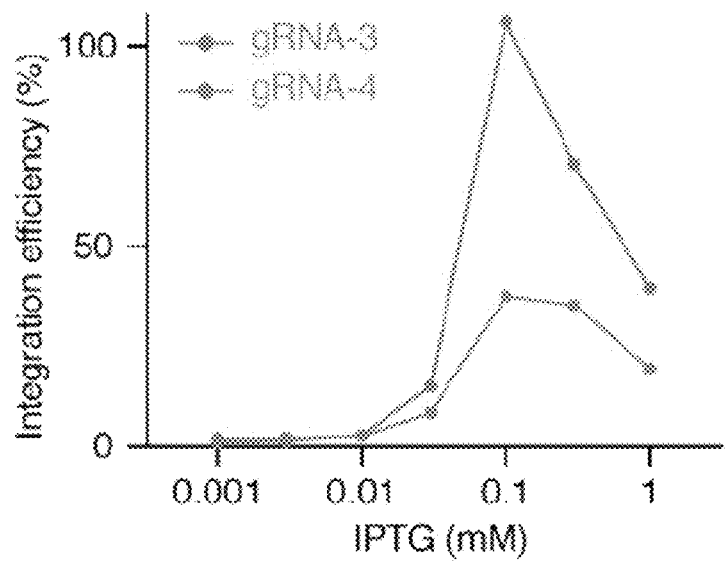

All transposition experiments were performed in *E. coli* BL21(DE3) cells (NEB). For experiments including pDonor, pTnsABC, and pQCascade (or variants thereof), chemically competent cells were first co-transformed with either pDonor and pTnsABC, pDonor and pQCascade, or pTnsABC and pQCascade, and transformants were isolated by selective plating on double antibiotic LB-agar plates. Liquid cultures were then inoculated from single colonies, and the resulting strains were made chemically competent using standard methods, aliquoted and snap frozen. The third plasmid was introduced in a new transformation reaction by heat shock, and after recovering cells in fresh LB medium at 37° C. for one hour, cells were plated on triple antibiotic LB-agar plates containing 100 μg/mL carbenicillin, 50 μg/mL kanamycin, and 50 μg/mL spectinomycin. After overnight growth at 37° C. for 16 hours, hundreds of colonies were scraped from the plates, and a portion was resuspended in fresh LB medium before being re-plated on triple antibiotic LB-agar plates as before, this time supplemented with 0.1 mM IPTG to induce protein expression. Solid media culturing was chosen over liquid culturing in order to avoid growth competition and population bottlenecks. Cells were incubated an additional 24 hours at 37° C. and typically grew as densely spaced colonies, before being scraped, resuspended in LB medium, and prepared for subsequent analysis. Control experiments lacking one or more molecular components were performed using empty vectors and the exact same protocol as above. Experiments investigating the effect of induction level on transposition efficiency had variable IPTG concentrations in the media (FIG. 10D). To isolate clonal, lacZ-integrated strains via blue-white colony screening, cells were re-plated on triple antibiotic LB-agar plates supplemented with 1 mM IPTG and 100 µg/mL X-gal (GoldBio) and grown overnight at 37° C. prior to colony PCR analysis.

PCR and Sanger Sequencing Analysis of Transposition Products.

Optical density measurements at 600 nm were taken of scraped colonies that had been resuspended in LB medium, and ~3.2×10$^8$ cells (the equivalent of 200 µL of $OD_{600}$=2.0) were transferred to a 96-well plate. Cells were pelleted by centrifugation at 4000×g for 5 minutes and resuspended in 80 µL of $H_2O$, before being lysed by incubating at 95° C. for 10 minutes in a thermal cycler. The cell debris was pelleted by centrifugation at 4000×g for 5 minutes, and 10 µL of lysate was removed and serially diluted with 90 µL of $H_2O$ to generate 10- and 100-fold lysate dilutions for qPCR and PCR analysis, respectively.

PCR products were generated with Q5 Hot Start High-Fidelity DNA Polymerase (NEB) using 5 µL of 100-fold diluted lysate per 12.5 µL reaction volume serving as template. Reactions contained 200 µM dNTPs and 0.5 µM primers, and were generally subjected to 30 thermal cycles with an annealing temperature of 66° C. Primer pairs contained one genome-specific primer and one transposon-specific primer, and were varied such that all possible integration orientations could be detected both upstream and downstream of the target site (see FIG. 101 for selected oligonucleotides). Colony PCRs (FIGS. 7B and 7G) were performed by inoculating overnight cultures with individual colonies and performing PCR analysis as described above. PCR amplicons were resolved by 1-2% agarose gel electrophoresis and visualized by staining with SYBR Safe (Thermo Scientific). Negative control samples were always analyzed in parallel with experimental samples to identify mispriming products, some of which presumably result from the analysis being performed on crude cell lysates that still contain the high-copy pDonor. PCRs were initially performed with different DNA polymerases, variable cycling conditions, and different sample preparation methods. It was noted that higher concentrations of the crude lysate appeared to inhibit successful amplification of the integrated transposition product.

To map integration sites by Sanger sequencing, bands were excised after separation by gel electrophoresis, DNA was isolated by Gel Extraction Kit (Qiagen), and samples were submitted to and analyzed by GENEWIZ.

Integration Site Distribution Analysis by Next-Generation Sequencing (NGS) of PCR Amplicons.

PCR-1 products were generated as described above, except that primers contained universal Illumina adapters as 5' overhangs (Table 5) and the cycle number was reduced to 20. These products were then diluted 20-fold into a fresh polymerase chain reaction (PCR-2) containing indexed p5/p7 primers and subjected to 10 additional thermal cycles using an annealing temperature of 65° C. After verifying amplification by analytical gel electrophoresis, barcoded reactions were pooled and resolved by 2% agarose gel electrophoresis, DNA was isolated by Gel Extraction Kit (Qiagen), and NGS libraries were quantified by qPCR using the NEBNext Library Quant Kit (NEB). Illumina sequencing was performed using a NextSeq mid output kit with 150-cycle single-end reads and automated demultiplexing and adapter trimming (Illumina). Individual bases with Phred quality scores under 20 (corresponding to a base miscalling rate of >1%) were changed to 'N,' and only reads with at least half the called bases above Q20 were retained for subsequent analysis.

To determine the integration site distribution for a given sample, the following steps were performed using custom Python scripts. First, reads were filtered based on the requirement that they contain 20-bp of perfectly matching transposon end sequence. 15 bp of sequence immediately flanking the transposon were then extracted and aligned to a 1-kb window of the *E. coli* BL21(DE3) genome (GenBank accession CP001509) surrounding the gRNA-matching genomic target site. The distance between the nearest transposon-genome junction and the PAM-distal edge of the 32-bp target site was determined. Histograms were plotted after compiling these distances across all the reads within a given library.

Cell Killing Experiments.

For experiments with Cas9, 40 µL chemically competent BL21(DE3) cells were transformed with 100 ng Cas9-sgRNA expression plasmid encoding either sgRNA-3 or sgRNA-4, which target equivalent lacZ sites as *V. cholerae* gRNA-3 and gRNA-4 but on opposite strands, or a truncated/non-functional sgRNA derived from the BsaI-containing entry vector (FIG. 100). After a one-hour recovery at 37° C., variable dilutions of cells were plated on LB-agar plates containing 100 µg/mL carbenicillin and 0.1 mM IPTG and grown an additional 16 hours at 37° C. The number of resulting colonies was quantified across three biological replicates, and the data were plotted as colony forming units (cfu) per g of plasmid DNA. Additional control experiments used an expression plasmid encoding Cas9 nuclease-inactivating D10A and H840A mutations (dCas9).

For experiments with Cascade and Cas2-3 from *P. aeruginosa*, BL21(DE3) cells were first transformed with a Cas2-3 expression vector, and the resulting strains were made chemically competent. 40 µL of these cells were then transformed with 100 ng PaeCascade expression plasmid encoding either gRNA-Pae3 or gRNA-Pae4, which target equivalent lacZ sites as *V. cholerae* gRNA-3 and gRNA-4, or a truncated/non-functional gRNA derived from the BsaI-containing entry vector (FIG. 100). After a one-hour recovery at 37° C., variable dilutions of cells were plated on LB-agar plates containing 100 µg/mL carbenicillin and 50 µg/mL kanamycin and grown an additional 16 hours at 37° C. The number of resulting colonies was quantified across three biological replicates, and the data were plotted as colony forming units (cfu) per g of plasmid DNA. Even low concentrations of IPTG led to gRNA-independent toxicity in these experiments, whereas gRNA-dependent cell killing was readily observed in the absence of induction, presumably from leaky expression by T7 RNAP. IPTG was omitted from experiments using PaeCascade and Cas2-3.

qPCR Analysis of Transposition Efficiency.

For both gRNA-3 and gRNA-4, pairs of transposon- and genome-specific primers were designed to amplify a ~140-240-bp fragment resulting from RNA-guided DNA integration at the expected lacZ locus in either orientation. A separate pair of genome-specific primers was designed to amplify an *E. coli* reference gene (rssA) for normalization purposes (FIG. 101). qPCR reactions (10 µL) contained 5 µL of SsoAdvanced Universal SYBR Green Supermix (Bio-Rad), 1 µL $H_2O$, 2 µL of 2.5 µM primers, and 2 µL of 10-fold diluted lysate prepared from scraped colonies, as described for the PCR analysis above. Reactions were prepared in 384-well clear/white PCR plates (BioRad), and measurements were performed on a CFX384 Real-Time PCR Detection System (BioRad) using the following thermal cycling parameters: polymerase activation and DNA denaturation (98° C. for 2.5 min), 40 cycles of amplification (98° C. for 10 s, 62° C. for 20 s), and terminal melt-curve analysis (65-95° C. in 0.5° C./5 s increments).

Figure 10E:
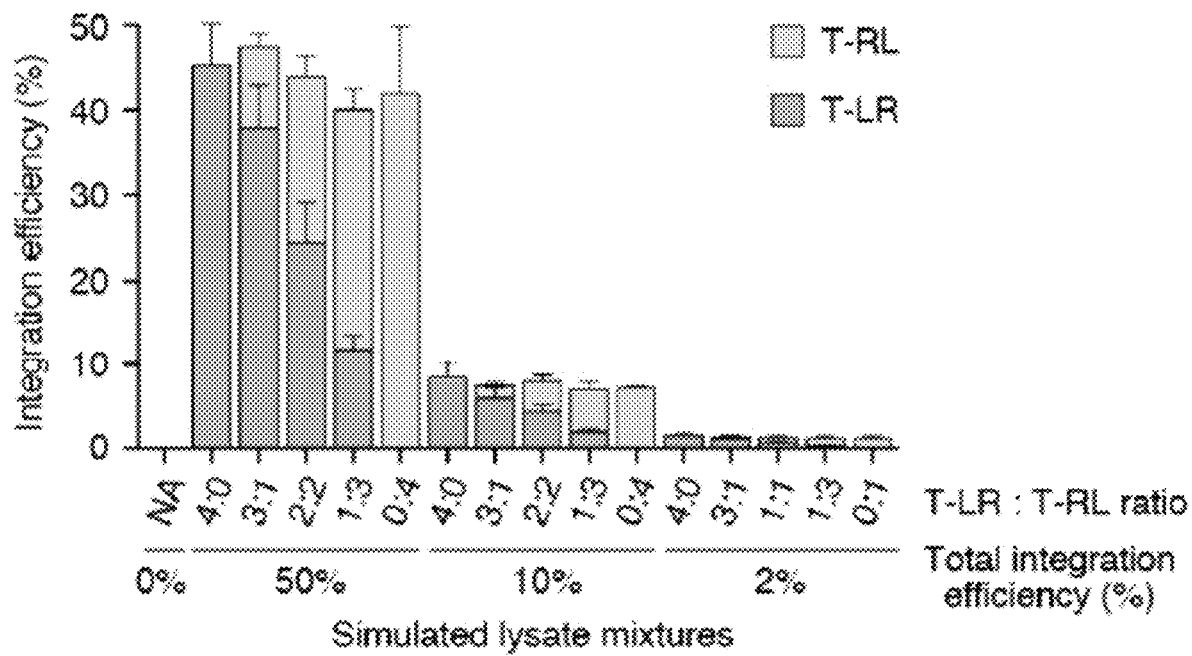

Lysates were prepared from a control BL21(DE3) strain containing pDonor and both empty expression vectors (pCOLADuet-1 and pCDFDuet-1), and from strains that underwent clonal integration into the lacZ locus downstream of both gRNA-3 and gRNA-4 target sites in both orientations. By testing the primer pairs with each of these samples diluted across five orders of magnitude, and then determining the resulting Cq values and PCR efficiencies, it was verified that the experimental and reference amplicons were amplified with similar efficiencies, and that the primer pairs selectively amplified the intended transposition product (FIGS. 10A and 10B). Variable transposition efficiencies across five orders of magnitude (ranging from 0.002-100%) were simulated by mixing control lysates and clonally-integrated lysates in various ratios, and accurate and reproducible detection of transposition products at both target sites, in either orientation, was shown at levels >0.01% (FIG. 10B). Finally, variable integration orientation biases were simulated by mixing clonally-integrated lysates together in varying ratios together with control lysates, and it was shown that these could also be accurately measured (FIGS. 10C and 10E).

In another qPCR analysis protocol, each biological sample was analyzed in three parallel reactions: one reaction contained a primer pair for the E. coli reference gene, a second reaction contained a primer pair for one of the two possible integration orientations, and a third reaction contained a primer pair for the other possible integration orientation. Transposition efficiency for each orientation was then calculated as $2^{\Delta Cq}$, in which $\Delta Cq$ is the Cq (quantitation cycle) difference between the experimental reaction and the control reaction. Total transposition efficiency for a given experiment was calculated as the sum of transposition efficiencies for both orientations. All measurements presented in the text and figures were determined from three independent biological replicates.

Experiments with pDonor variants were performed by delivering pDonor in the final transformation step, whereas most other experiments were performed by delivering pQCascade in the final transformation step. Integration efficiencies between samples from these two experiments appeared to differ slightly as a result (compare FIG. 3B to FIG. 3C). Additionally, to not bias the qPCR analysis of the donor end truncation samples by successively shortening the PCR amplicon, different primer pairs were used for these samples. Within the left and right end truncation panel (FIGS. 11B-11D), the transposon end that was not being perturbed was selectively amplified for qPCR analysis.

Recombinant Protein Expression and Purification.

The protein components for Cascade, TniQ, and TniQ-Cascade were expressed from a pET-derivative vector containing an N-terminal $His_{10}$-MBP-TEVsite fusion on Cas8, TniQ, and TniQ, respectively (see FIG. 8A). The gRNAs for Cascade and TniQ-Cascade were expressed separately from a pACYC-derivative vector. E. coli BL21(DE3) cells harboring one or both plasmids were grown in 2×YT medium with the appropriate antibiotic(s) at 37° C. to $OD_{600}$=0.5-0.7, at which point IPTG was added to a final concentration of 0.5 mM and growth was allowed to continue at 16° C. for an additional 12-16 hours. Cells were harvested by centrifugation at 4,000×g for 20 minutes at 4° C.

Cascade and TniQ-Cascade were purified as follows. Cell pellets were resuspended in Cascade Lysis Buffer (50 mM Tris-Cl, pH 7.5, 100 mM NaCl, 0.5 mM PMSF, EDTA-free Protease Inhibitor Cocktail tablets (Roche), 1 mM DTT, 5% glycerol) and lysed by sonication with a sonic dismembrator (Fisher) set to 40% amplitude and 12 minutes total process time (cycles of 10 seconds on and 20 seconds off, for a total of 4 minutes on and 8 minutes off). Lysates were clarified by centrifugation at 15,000×g for 30 minutes at 4° C. Initial purification was performed by immobilized metal-ion affinity chromatography with Ni-NTA Agarose (Qiagen) using NiNTA Wash Buffer (50 mM Tris-Cl, pH 7.5, 100 mM NaCl, 10 mM imidazole, 1 mM DTT, 5% glycerol) and NiNTA Elution Buffer (50 mM Tris-Cl pH 7.5, 100 mM NaCl, 300 mM imidazole, 1 mM DTT, 5% glycerol). The $His_{10}$-MBP fusion was removed by incubation with TEV protease overnight at 4° C. in NiNTA Elution Buffer, and complexes were further purified by anion exchange chromatography on an AKTApure system (GE Healthcare) using a 5 mL HiTrap Q HP Column (GE Healthcare) with a linear gradient from 100% Buffer A (20 mM Tris-Cl, pH 7.5, 100 mM NaCl, 1 mM DTT, 5% glycerol) to 100% Buffer B (20 mM Tris-Cl, pH 7.5, 1 M NaCl, 1 mM DTT, 5% glycerol) over 20 column volumes. Pooled fractions were identified by SDS-PAGE analysis and concentrated, and the sample was further refined by size exclusion chromatography over one or two tandem Superose 6 Increase 10/300 columns (GE Healthcare) equilibrated with Cascade Storage Buffer (20 mM Tris-Cl, pH 7.5, 200 mM NaCl, 1 mM DTT, 5% glycerol). Fractions were pooled, concentrated, snap frozen in liquid nitrogen, and stored at −80° C.

TniQ was purified similarly, except the Lysis, NiNTA Wash, and NiNTA Elution Buffers contained 500 mM NaCl instead of 100 mM NaCl. Separation by ion exchange chromatography was performed on a 5 mL HiTrap SP HP Column (GE Healthcare) using the same Buffer A and Buffer B as above, and the final size exclusion chromatography step was performed on a HiLoad Superdex 75 16/600 column (GE Healthcare) in Cascade Storage Buffer. The TniQ protein used in TniQ-Cascade binding experiments (FIG. 8E) contained an N-terminal StrepII tag.

Mass Spectrometry Analysis.

0.5-5 µg of total protein were separated on 4-20% gradient SDS-PAGE and stained with Imperial Protein Stain (Thermo Scientific). In-gel digestion was performed essentially as described by Shevchenko, A., et al. (Nat Protoc 1, 2856-2860 (2006), incorporated herein by reference), with minor modifications. Protein gel slices were excised, washed with 1:1 acetonitrile: 100 mM ammonium bicarbonate (v/v) for 30 minutes, dehydrated with 100% acetonitrile for 10 minutes, and dried in a speed-vac for 10 minutes without heat. Gel slices were reduced with 5 mM DTT for 30 minutes at 56° C. and then alkylated with 11 mM iodoacetamide for 30 minutes at room temperature in the dark. Gel slices were washed with 100 mM ammonium bicarbonate and 100% acetonitrile for 10 minutes each, and excess acetonitrile was removed by drying in a speed-vac for 10 minutes without heat. Gel slices were then rehydrated in a solution of 25 ng/l trypsin in 50 mM ammonium bicarbonate for 30 minutes on ice, and trypsin digestion was performed overnight at 37° C. Digested peptides were collected and further extracted from gel slices in MS Extraction Buffer (1:2 5% formic acid/acetonitrile (v/v)) with high-speed shaking. Supernatants were dried down in a speed-vac, and peptides were dissolved in a solution containing 3% acetonitrile and 0.1% formic acid.

Desalted peptides were injected onto an EASY-Spray PepMap RSLC C18 50 cm×75 m column (Thermo Scientific), which was coupled to the Orbitrap Fusion Tribrid mass spectrometer (Thermo Scientific). Peptides were eluted with a non-linear 100-minute gradient of 5-30% MS Buffer B (MS Buffer A: 0.1% (v/v) formic acid in water; MS Buffer B: 0.1% (v/v) formic acid in acetonitrile) at a flow rate of 250 nL/min. Survey scans of peptide precursors were performed from 400 to 1575 m/z at 120K FWHM resolution (at 200 m/z) with a $2\times10^5$ ion count target and a maximum injection time of 50 milliseconds. The instrument was set to run in top speed mode with 3-second cycles for the survey and the MS/MS scans. After a survey scan, tandem MS was performed on the most abundant precursors exhibiting a charge state from 2 to 6 of greater than $5\times10^3$ intensity by isolating them in the quadrupole at 1.6 Th. CID fragmentation was applied with 35% collision energy, and resulting fragments were detected using the rapid scan rate in the ion trap. The AGC target for MS/MS was set to $1\times10^4$ and the maximum injection time limited to 35 milliseconds. The dynamic exclusion was set to 45 seconds with a 10-ppm mass tolerance around the precursor and its isotopes. Monoisotopic precursor selection was enabled.

Raw mass spectrometric data were processed and searched using the Sequest HT search engine within the Proteome Discoverer 2.2 software (Thermo Scientific) with custom sequences and the reference *Escherichia coli* BL21 (DE3) strain database downloaded from Uniprot. The default search settings used for protein identification were as follows: two mis-cleavages for full trypsin, with fixed carbamidomethyl modification of cysteine and oxidation of methionine; deamidation of asparagine and glutamine and acetylation on protein N-termini were used as variable modifications. Identified peptides were filtered for a maximum 1% false discovery rate using the Percolator algorithm, and the PD2.2 output combined folder was uploaded in Scaffold (Proteome Software) for data visualization. Spectral counting was used for analysis to compare the samples.

gRNA analysis and RNA-seq. To analyze the nucleic acid component co-purifying with Cascade and TniQ-Cascade, nucleic acids were isolated by phenol-chloroform extraction, resolved by 10% denaturing urea-PAGE, and visualized by staining with SYBR Gold (Thermo Scientific). Analytical RNase and DNase digestions were performed in 10 μL reactions with ~4 pmol nucleic acid and either 10 μg RNase A (Thermo Scientific) or 2 Units DNase I (NEB), and were analyzed by 10% denaturing urea-PAGE and SYBR Gold staining.

RNA-seq was performed generally as described in Heidrich, N., et al., *Methods Mol Biol* 1311, 1-21 (2015), incorporated herein by reference. Briefly, RNA was isolated from Cascade and TniQ-Cascade complexes by phenol-chloroform extraction, ethanol precipitated, and 5'-phosphorylated/3'-dephosphorylated using T4 polynucleotide kinase (NEB), followed by clean-up using the ssDNA/RNA Clean & Concentrator Kit (Zymo Research). A ssDNA universal Illumina adapter containing 5'-adenylation and 3'-dideoxycytidine modifications (Table 5) was ligated to the 3' end with T4 RNA Ligase 1 (NEB), followed by hybridization of a ssDNA reverse transcriptase primer and ligation of ssRNA universal Illumina adapter to the 5' end with T4 RNA Ligase 1 (NEB). cDNA was synthesized using Maxima H Minus Reverse Transcriptase (Thermo Scientific), followed by PCR amplification using indexed p5/p7 primers. Illumina sequencing was performed using a NextSeq mid output kit with 150-cycle single-end reads and automated demultiplexing and adapter trimming (Illumina). Individual bases with Phred quality scores under 20 (corresponding to a base miscalling rate of >1%) were changed to 'N,' and only reads with at least half the called bases above Q20 were retained for subsequent analysis. Reads were aligned to the gRNA expression plasmid used for recombinant Cascade and TniQ-Cascade expression and purification.

TniQ-Cascade Binding Experiments.

Binding reactions (120 μL) contained 1 μM Cascade and 5 M StrepII-tagged TniQ, and were prepared in Cascade Storage Buffer and incubated at room temperature for 30 minutes, prior to being loaded into a 100 μL sample loop on an AKTApure system (GE Healthcare). Reactions were resolved by size exclusion chromatography over a Superose 6 Increase 10/300 column (GE Healthcare) in Cascade Storage Buffer, and proteins in each peak fraction were acetone precipitated and analyzed by SDS-PAGE. Control reactions lacked either Cascade or TniQ.

Tn-seq Experiments.

Transposition experiments were performed as described above, except pDonor contained two point mutations in the transposon right end that introduced an MmeI restriction site (FIGS. 13A-13B). Colonies from triple antibiotic LB-agar plates containing IPTG (typically numbering in the range of $10^2$-$10^3$) were resuspended in 4 mL fresh LB medium, and 0.5 mL (corresponding to ~$2\times10^9$ cells) was used for genomic DNA (gDNA) extraction with the Wizard Genomic DNA Purification Kit (Promega). This procedure typically yielded 50 μL of 0.5-1.5 μg/L gDNA, which is a mixture of the *E. coli* circular chromosome (4.6 Mbp, copy number of 1), pDonor (3.6 kb, copy number 100+), pTnsABC (6.9 kb, copy number ~20-40), and pQCascade (8.4 kb, copy number ~20-40).

NGS libraries were prepared in parallel on 96-well plates, as follows. First, 1 μg of gDNA was digested with 4 Units of MmeI (NEB) for 12 hours at 37° C. in a 50 μL reaction containing 50 μM S-adenosyl methionine and 1× CutSmart Buffer, prior to heat inactivation at 65° C. for 20 minutes. MmeI cleaves the transposon 17/19 nucleotides (nt) outside of the terminal repeat, leaving 2-nt 3'-overhangs. Reactions were cleaned up using 1.8×Mag-Bind TotalPure NGS magnetic beads (Omega) according to the manufacturer's instructions, and eluted using 30 L of 10 mM Tris-Cl, pH 7.0. MmeI-digested gDNA was ligated to a double-stranded i5 universal adapter containing a terminal 5'-NN-3' overhang (FIG. 101) in a 20 μL ligation reaction containing 16.86 μL of MmeI-digested gDNA, 280 nM adapter, 400 Units of T4 DNA ligase (NEB), and 1×T4 DNA Ligase Buffer. Reactions were incubated at room temperature for 30 minutes, before being cleaned up with magnetic beads as before. To reduce the degree of pDonor contamination within the NGS libraries, since pDonor also contains the full-length transposon with an MmeI site, a unique HindIII restriction site just outside the transposon right end within pDonor was used. The entirety of the adapter-ligated gDNA sample was thus digested with 20 Units of HindIII (NEB) in a 34.4 μL reaction for one hour at 37° C., before a heat inactivation step at 65° C. for 20 minutes. Magnetic bead-based DNA clean-up was performed as before.

Adapter-ligated transposons were enriched in a PCR-1 step using a universal i5 adapter primer and a transposon-specific primer containing a universal i7 adapter as 5' overhang. Reactions were 25 μL in volume and contained 16.75 μL of HindIII-digested gDNA, 200 μM dNTPs, 0.5 μM primers, 1×Q5 Reaction Buffer, and 0.5 Units Q5 Hot Start High-Fidelity DNA Polymerase (NEB). Amplification was allowed to proceed for 25 cycles, with an annealing temperature of 66° C. Reaction products were then diluted 20-fold into a second 20 μL polymerase chain reaction (PCR-2) containing indexed p5/p7 primers, and this was subjected to 10 additional thermal cycles using an annealing temperature of 65° C. After verifying amplification for select libraries by analytical gel electrophoresis, barcoded reactions were pooled and resolved by 2% agarose gel electrophoresis, DNA was isolated by Gel Extraction Kit (Qiagen), and NGS libraries were quantified by qPCR using the NEBNext Library Quant Kit (NEB). Illumina sequencing was performed using a NextSeq mid output kit with 150-cycle single-end reads and automated demultiplexing and adapter trimming (Illumina). Individual bases with Phred quality scores under 20 (corresponding to a base miscalling rate of >1%) were changed to 'N,' and only reads with at least half the called bases above Q20 were retained for subsequent analysis.

Tn-seq libraries with the mariner/Himar1C9 were prepared as for the V. cholerae, but with the following changes. Transformation reactions utilized BL21(DE3) cells and a single pDonor plasmid, which encodes a KanR-containing mariner transposon with MmeI sites on both ends, and a separate expression cassette for the Himar1C9 transposase controlled by a lac promoter. Transformed cells were recovered at 37° C. for one hour before being plated on bioassay dishes containing 100 μg/mL carbenicillin, yielding on the order of $5 \times 10^4$ colonies. Cells were resuspended in 20 mL fresh LB medium after a single 16-hour overnight growth, and the equivalent of $\sim 2 \times 10^9$ cells were used for genomic DNA (gDNA) extraction. NGS libraries were prepared as described above, except the restriction enzyme digestion reactions to deplete pDonor contained 20 Units of BamHI and KpnI instead of HindIII.

Tn-Seq Data Visualization and Bioinformatic Analysis.

The software application Geneious Prime was used to further filter reads based on three criteria: that read lengths correspond to the expected products resulting from MmeI cleavage of and adapter ligation to genomically integrated transposons (112-113-bp for the V. cholerae transposon and 87-88-bp for mariner); that each read contain the expected transposon end sequence (allowing for one mismatch); and that the transposon-flanking sequence (trimmed to 17-bp for the V. cholerae transposon and 14-bp for mariner) map perfectly to the reference genome. Mapping to the E. coli BL21(DE3) genome (GenBank accession CP001509) was done using the function 'Map to reference' and the following settings. Mapper: Geneious; Fine tuning: None (fast/read mapping); Word length: 17; Maximum mismatches: 0%; Maximum Ambiguity: 1. The 'Map multiple best matches' setting was set to either 'none,' effectively excluding any reads except those that map uniquely to a single site (referred to as 'uniquely mapping reads'), or to 'all,' which allows reads to map to one or multiple sites on the E. coli genome (referred to as 'processed mapping reads'). Both sets of reads were exported as fastq files and used for downstream analysis using custom Python scripts. Many reads removed in this process perfectly mapped to the donor plasmid, indicating that HindIII or BamHI/KpnI cleavage was insufficient to completely remove contaminating pDonor-derived sequences. Coverage data for 'processed mapping reads' were exported to generate FIG. 4F.

To visualize the genome-wide integration site distribution for a given sample, 'uniquely mapping reads' were mapped to the same E. coli reference genome but this time with custom Python scripts. The integration site for each read was defined as the genomic coordinate (with respect to the reference genome) corresponding to the 3' edge of the mapped read. For visualization purposes, integration events within 5-kb bins were computed and plotted as genome-wide histograms in FIGS. 4C, 4, 14A and 14B. Plots were generated using the Matplotlib graphical library. The sequence logo in FIG. 4D was generated using WebLogo 3.

Plots comparing integration sites among biological replicates (FIG. 13D-13I) were generated by either binning the genome wide histograms based on gene annotations (mariner) using GenBank accession CP001509, or into 100-bp bins (V. cholerae transposon). For the V. cholerae transposon, the bins were shifted so that the 3' end of the Cascade target site for each sample would correspond to the start of its corresponding 100-bp bin. Linear regression and bivariate analysis for the mariner plot (FIG. 13D) was performed using the SciPy statistical package.

To analyze the primary integration site for each sample, custom Python scripts were used to map 'processed mapping reads' to a 600-bp genomic window surrounding the corresponding genomic target site. For reads mapping to the opposite strand as the target (i.e. for the T-LR orientation, in which integration places the 'left' transposon end closest to the Cascade binding site), the integration site was shifted 5-bp from the 3' edge of the target site in order to account for the 5-bp TSD. The primary integration site within this 600-bp window was defined by the largest number of mapped reads, while it was arbitrarily designated that the 100 bp centered at the primary integration site as the 'on-target' window. The percentage of on-target integration for each sample was calculated as the number of reads resulting from transposition within the 100-bp window, divided by the total number of reads mapping to the genome. The ratio of integration in one orientation versus the other was also determined; this parameter only utilized on-target reads, and was calculated as the number of reads resulting from integration of the transposon 'right' end closest to the Cascade binding site (T-RL), divided by the number reads resulting from integration of the transposon left end closest to the Cascade target site (T-LR). The distribution of integration around the primary site was plotted for both orientations for each sample, and was used to generate FIGS. 4E and 14C-E. This analysis was susceptible to potential biases from differential efficiencies in the ligation of 5'-NN-3' overhang adapters, which was not considered.

Statistics and Reproducibility.

Analytical PCRs resolved by agarose gel electrophoresis gave similar results in three independent replicates (FIGS. 1D, 1E, 11I, 2A and 4A) or were analyzed by gel electrophoresis once (FIGS. 2E, 6D, 7B, 7D, and 7F) but verified with qPCR for three independent replicates (FIG. 2E). Sanger sequencing and next-generation sequencing of PCR amplicons was performed once (FIGS. 1F, 1G, 3E, 3G, 4E, 6E, 7A, and 7E). SDS-PAGE experiments were performed for two or more different preparations of the same protein complexes and yielded similar results (FIGS. 2B and 8B). Protein binding reactions were performed and analyzed by SDS-PAGE once (FIG. 8E). Nucleic acid extraction from purified protein preparations and urea-PAGE analysis of samples with and without RNase or DNase treatment was performed twice, with similar results (FIGS. 2C and 8D); RNA sequencing was performed once (FIG. 2D).

Example 2

RNA-Guided DNA Integration in Eukaryotic Cells Via CRISPR-Tn7 Systems

Tn7-like transposons that encode CRISPR-Cas systems can be used for programmable DNA integration, in which the nuclease-deficient CRISPR-Cas machinery (either Cascade from Type I systems, or C2c5 from Type V systems) coordinates with Tn7 transposon-associated proteins to mediate RNA-guided DNA targeting and DNA integration, respectively.

Herein are described experiments to heterologously express the machinery in human cells, in order to perform RNA-guided DNA integration experiments in eukaryotic cells. The expression constructs and experimental details described below may be used for performing RNA-guided DNA integration in immortalized human cell lines (e.g. HEK293T). They may be modified to enable expression and reconstitution of RNA-guided DNA integration in other eukaryotic cell types, e.g., by altering the promoters, codon optimization, nuclear localization signals, vector designs, and delivery methods, among other parameters. The other eukaryotic cells where CRISPR-Tn7 may be expressed and reconstituted include, but are not limited to, other *Homo sapiens* cell lines (immortalized or primary, T-cells, B-cells, hematopoietic stem cells, embryonic stem cells, induced pluripotent stem cells, etc.), cells derived from *M. musculus, Caenorhabditis elegans, Drosophila melanogaster, Saccharomyces cerevisae*, and more.

There are currently large limitations and risks associated with the use of CRISPR-Cas9 and other programmable nucleases for insertion of large gene cargos into eukaryotic genomes.

Gene integration with CRISPR-Cas9 requires introduction of DSBs and the use of synthetic repair donor templates carrying appropriate designed homology arms. Homology donors work with the highest efficiency when supplied as recombinant AAV vectors or ssDNA, but these are also extremely laborious to produce [see e.g. H. Li, M. D. Leonetti, *BioRxiv*, 1-24 (2017), incorporated herein by reference]. Furthermore, cloning of dsDNA donor templates with homology arms can be time-consuming and tedious. In contrast, the method described herein obviates the need for homology arms to be redesigned for every new target site, because the targeting comes exclusively from the guide RNA, and the same donor, namely the engineered transposon donor DNA, is used for any arbitrary target site.

Gene integration with CRISPR-Cas9 and donor templates relies on homology-directed repair (HDR) for proper integration of the donor template. However, HDR efficiencies are known to be extremely low in many different cell types, and the DSBs that precede HDR are always repaired in heterogeneous ways across a cell population: some cells undergo HDR at one or both alleles, whereas far more cells undergo non-homologous end joining (NHEJ) at one or both alleles, which leads to small insertions or deletions being introduced at the target site [reviewed in: K. S. Pawelczak, N. S. Gavande, P. S. VanderVere-Carozza, J. J. Turchi, *ACS Chem Biol.* 13, 389-396 (2018), incorporated herein by reference]. This means that, across a cell population (e.g. as would be edited in a therapeutic or experimental application), only a small percentage of cells undergo the desired site-specific gene integration, whereas a far greater percentage undergoes heterogeneous repairs. In contrast, an RNA-guided transposase mechanism for gene integration does not proceed through a DSB intermediate, and thus does not allow for NHEJ-mediate insertions or deletions to arise. Rather, targeting of the DNA leads to direct integration through a concerted transesterification reaction, such that targeting involves direct integration without any other off-pathway alternatives.

The endogenous machinery for HDR is virtually absent in post-mitotic cells (i.e. non-dividing cells, which do not undergo DNA replication), such as neurons and terminally differentiated cells. Thus, there are no options for precise, targeted gene integration in these cell types. The RNA-guided DNA integration method described herein, on the other hand, offers an alternative approach for precise integration in these cell types.

DSBs, which are necessary precursors for CRISPR-Cas9 mediated HDR pathways for gene integration, are known to pose hazards for cells. DSBs at off-target sites introduce off-target mutations; DSBs can provoke a DNA damage response [E. Haapaniemi, S. Botla, J. Persson, B. Schmierer, J. Taipale, *Nat. Med.* 24, 927-930 (2018)]; DSBs can lead to selection for p53 null cells, which have increased risk of tumorigenesis [R. J. Ihry et al., *Nat. Med.* 24, 939-946 (2018)]; and DSB repair at on-target sites can cause large-scale gene deletions, inversions, or chromosome translocations [M. Kosicki, K. Tomberg, A. Bradley, *Nat Biotechnol.* 36, 765-771 (2018)]. The method for integrating DNA in an RNA-guided target-specific manner obviates the need to introduce DSBs, and thus precludes all of the above hazards.

Many gene therapy products, either commercialized or in clinical trials, use randomly integrating viruses to ferry therapeutics into the genome of patient cells [Naldini et al., *Science* 353, 1101-1102 (2016)]. With the method described herein, these therapeutic genes are integrated into known safe harbor loci within the genome, where stable expression can be assured, and risks of insertional mutagenesis are entirely avoided [M. Bokhoven et al., *J Virol.* 83, 283-294 (2009)].

In one embodiment, the system described herein can be used for cancer immunotherapy, a rapidly growing and promising area for cancer treatment. Recent advances have showcased the potential for CAR-T therapy, in which chimeric antigen receptors are integrated into T cells designed to recognize particular epitopes particular to certain cancer types [C. H. June, M. Sadelain, *N. Engl. J. Med.* 379, 64-73 (2018)]. Recent work has shown that CAR-T cells have increased efficacy when the CAR gene is integrated into defined sites in the genome, rather than random sites [J. Eyquem et al., *Nature.* 543, 113-117 (2017)].

Expression Vector Design

Figure 18:
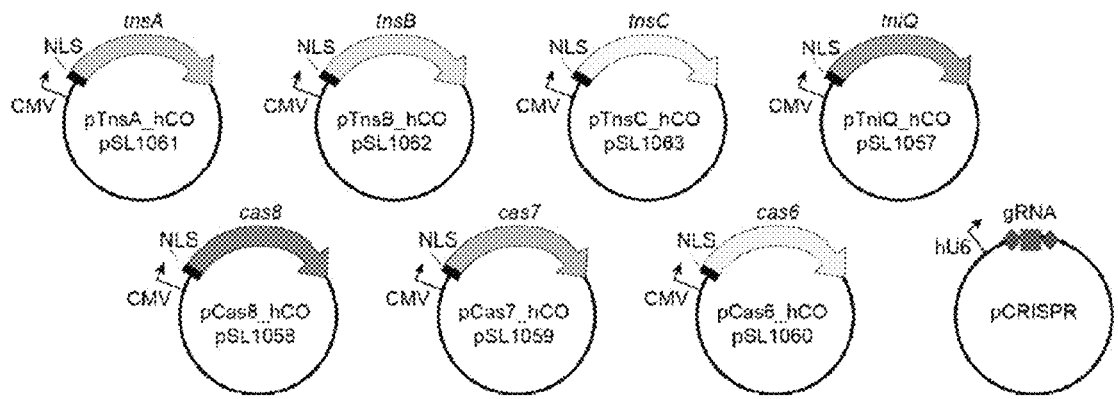
FIG. 18 is an expression strategy involving individual vectors for each component. Each component necessary for RNA-guided DNA integration with the CRISPR-Tn7 system from *Vibrio cholerae* is encoded on a separate mammalian expression plasmid. The protein-coding genes are human codon optimized (hCO), cloned downstream of a CMV promoter, and contain an N-terminal nuclear localization signal (NLS). In other embodiments, the NLS may also be introduced in tandem or at the C-terminus of the protein. The CRISPR array encoding the gRNA is cloned downstream of a human U6 (hU6) promoter, and is designed as a repeatspacer-repeat array, which is processed by Cas6. The particular spacer sequence (maroon) is chosen to correspond to the desired DNA target site. In this embodiment, all 8 plasmids are co-transfected to reconstitute TniQCascade and TnsABC in cells, which together with pDonor, can mediate RNA-guided DNA integration.

In one embodiment, the guide RNA (gRNA) and CRISPR- and Tn7-associated genes are all expressed from individual plasmids and delivered transiently (FIG. 18). The gRNA is encoded as a repeat-spacer-repeat CRISPR array, and is cloned downstream of a human U6 promoter; other promoters may be used, and in other embodiments, the CRISPR array may be expressed from promoters recognized by RNA Polymerase II, for example if the CRISPR array is encoded within the 3' untranslated region (UTR) of a coding mRNA, allowing for export to and processing in the cytoplasm. The CRISPR-associated (cas) and Tn7-associated (tns and tni) genes are cloned downstream of a cytomegalovirus (CMV) enhancer and promoter, allowing for expression by RNA Pol II, though in other embodiments the promoter may be replaced with other constitutive mammalian promoters, or inducible promoters, allowing for small molecule control of gene expression. The above vector designs require co-transfection of all the components, in order to reconstitute the CRISPR-Tn7 machinery inside eukaryotic cells, though other strategies are possible too (e.g. stable transfection via integration of one or more of the components, viral transduction, etc.).

Figure 19:
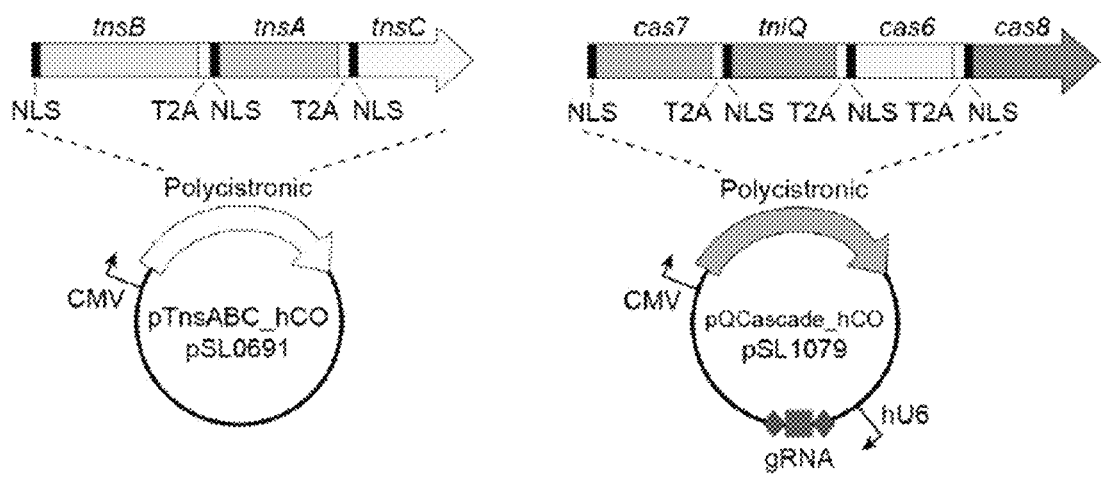
FIG. 19 is an exemplary expression strategy involving polycistronic vectors. pTnsABC_hCO encodes human codon-optimized versions of TnsA, TnsB, and TnsC, with the NLS and T2A peptides shown. pQCascade_hCO encodes human codon-optimized version of TniQ, Cas6, Cas7, and Cas8, as well as a CRISPR array encoding the gRNA. The promoters for both vectors are shown. In other embodiments, the order of genes is changed to optimize expression, and the position and identity of the NLS and 2A peptides is altered. The CRISPR array encoding the gRNA is cloned downstream of a human U6 (hU6) promoter, and is designed as a repeat-spacer-repeat array, which is processed by Cas6. The particular spacer sequence (maroon) is chosen to correspond to the desired DNA target site. In this embodiment, both plasmids are co-transfected to reconstitute TniQ-Cascade and TnsABC in cells, which together with pDonor, can mediate RNA-guided DNA integration. The pQCascade_hCO variant (pSL1079) encodes a gRNA targeting a lacZ-specific sequence from E. coli, which is one embodiment, is cloned within pTarget for RNA-guided DNA integration experiments in eukaryotic cells.

In another embodiment, the CRISPR- and Tn7-associated machineries are expressed from two polycistronic vectors (FIG. 19), which are also delivered to cells via transient transfection; in other embodiments, the expression constructs are stably transfected or integrated via viral transduction. In experiments expressing the CRISPR-Tn7 system from Type IF variant *Vibrio cholerae*, one polycistronic vector is denoted pTnsABC_hCO and encodes TnsA, TnsB, and TnsC; and a second polycistronic vector is named pQCascade_hCO and encodes TniQ, Cas8 (Cas8 is a natural fusion of Cas8 and Cas5 polypeptides, hereafter referred to simply as Cas8 in this Example for Type IF variants), Cas7, Cas6, and the gRNA, encoded as a CRISPR array (i.e. repeat-spacer-repeat). The polycistronic vectors exhibit the following design criteria:
- a single CMV promoter drives expression of a single polypeptide fusion construct;
- each protein-coding gene encodes an N-terminal nuclear localization signal (NLS);
- each protein-coding gene within the fusion construct, except the 3'-terminal gene, encodes a C-terminal 2A virally derived 'ribosome skipping' peptide; and
- a human U6 promoter drives expression of the precursor CRISPR RNA.

The 2A peptides are derived from thosea asigna virus (T2A), but may also be derived from other viral 2A sequences; these peptides cause the ribosome to anomalously terminate translation at the C-terminus of the peptide but then immediately reinitiate translation on the following codon, allowing multiple polypeptide products to be expressed from a single mRNA transcript (Liu, Z. et al. *Sci Rep* 7, 2193 (2017)). In other embodiments of this approach, different promoters are used, the NLS is moved from the N-terminus to the C-terminus, the NLS is removed or additional NLSs are added, and/or the order of genes within a polycistronic construct is rearranged. One or more polycistronic vectors may also be co-transfected with expression vectors encoding individual components (an "add-back" strategy), in order to provide higher levels of expression of particular molecular components. The CRISPR may also be separately encoded on its own plasmid, and pQCascade_hCO may be modified so that it no longer encodes the hU6-driven CRISPR RNA.

Alternative Delivery Approaches for CRISPR-Tn7 Machinery

Figures 20A, 20B, 20C:
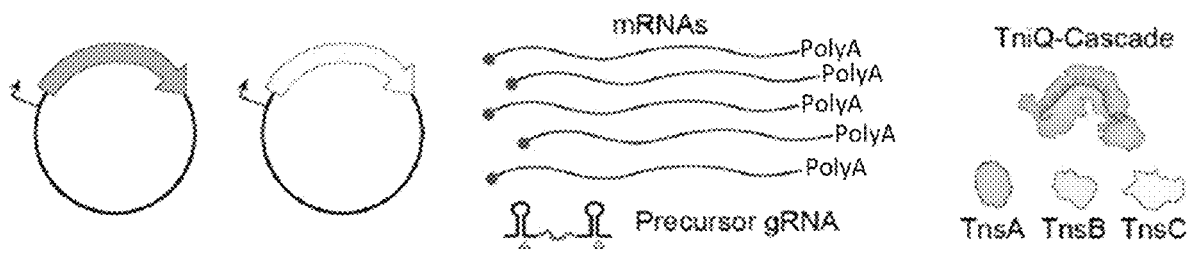
FIGS. 20A-20C show possible delivery approaches.

The CRISPR- and Tn7-associated machinery may also be delivered via mRNA transfection. In one embodiment, individual capped and polyadenylated mRNAs encoding each of the CRISPR- and Tn7-associated proteins are co-transfected, together with a CRISPR RNA (FIG. 20). The CRISPR RNA may be delivered as a fully mature gRNA; it may be delivered as a precursor CRISPR RNA containing complete repeat sequences on the 5' and 3' ends, which would be processed by Cas6 in cells; it may contain additional chemical modifications for increased cellular stability. In another embodiment, the CRISPR RNA is delivered similarly, together with capped and polyadenylated mRNAs encoding multiple protein products connected with 2A linker sequences, as described above.

The CRISPR- and Tn7-associated machinery may also be delivered as purified protein and ribonucleoprotein (RNP) components. TniQ-Cascade, TnsA, TnsB, and TnsC are purified separately and then mixed together, prior to transfection.

The CRISPR RNA may also be encoded on a synthetic repeat-spacer-repeat CRISPR array that is generated by PCR amplification and transfected directly as a linear DNA, rather than being cloned into pQCascade_hCO.

Experimental Strategy for Reconstituting RNA-Guided DNA Integration in HEK293T Cells Experiments to monitor RNA-guided DNA integration activity by CRISPR-Tn7 in eukaryotic cells are performed with multiple distinct approaches.

Figure 21A:
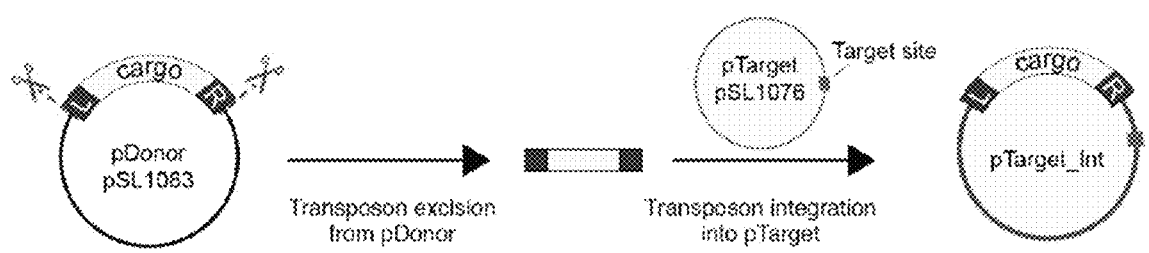
FIGS. 21A and 21B are exemplary experimental strategies for RNA-guided DNA integration in HEK293T cells.
Figure 21B:
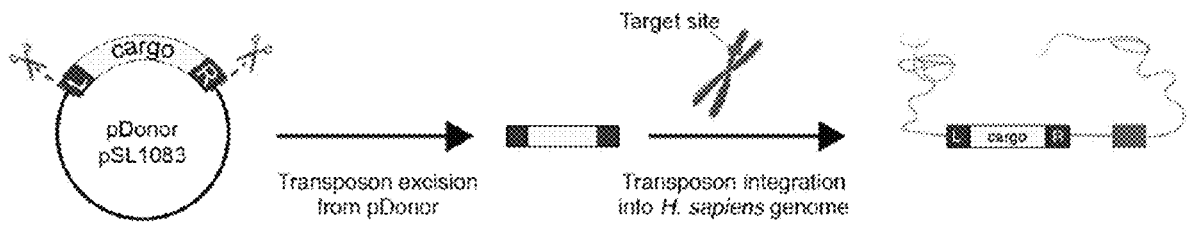

In one embodiment (see FIG. 21A), the donor DNA is present on a circular plasmid, denoted pDonor, and the target DNA, defined as the DNA sequence complementary to the gRNA, is present on a separate circular plasmid, denoted pTarget. HEK293T cells are co-transfected with the expression vectors (described above) and both pDonor and pTarget, leading to excision of the genetic cargo from pDonor (defined by the Tn7 transposon end sequences) and integration of the genetic cargo a fixed distance downstream of the target DNA on pTarget. Detection of successful integration events is described below. pDonor and pTarget may also be transfected together with mRNA and CRISPR RNA components, or with purified protein and RNP components In another embodiment (see FIG. 21B), the donor DNA is present on a circular plasmid, denoted pDonor, and the target DNA, defined as the DNA sequence complementary to the gRNA, is present on the *Homo sapiens* genome. HEK293T cells are co-transfected with the expression vectors (described above) and pDonor, leading to excision of the genetic cargo from pDonor (defined by the Tn7 transposon end sequences) and integration of the genetic cargo a fixed distance downstream of the target DNA within the genome. Detection of successful integration events is described below. pDonor may also be transfected together with mRNA and CRISPR RNA components, or with purified protein and RNP components.

The donor DNA, which contains the right and left transposon end sequences flanking the genetic cargo of interest, may also be delivered as part of a viral vector (e.g. rAAV), or as a linear double-stranded DNA (dsDNA). In the context of a linear dsDNA, the transfected construct may terminate immediately with the transposon left and right ends, or may contain additional flanking sequence.

Transfection and HEK293T Cell Culturing

HEK293T cells are passaged and plated at 10% confluency (media: DMEM, 10% Hi-FBS, 1% PSG). Approximately 16 hrs after passaging, the cells are transfected with the CRISPR-Tn7 machinery, pDonor, and pTarget (when present), according to the various design parameters described above. Cells are cultured for minimum 24 hrs, and no longer than to confluency. When confluent, the cells are lifted from the plate and divided into thirds, one third is taken for flow cytometry, one third is lysed and the cell lysate is used as template for PCR-based assays, the last third are passaged without further splitting. Cells selected for flow cytometry analysis are gated to achieve live singlets, and from that gate, visualized on a GFP axis by mCherry axis. As described in the following section, in one embodiment, the population of HEK293T cells in the mCherrynegative/EGFP-positive quadrant should have undergone successful RNA-guided DNA integration, and these cells may be sorted (either bulk or single-cell), grown to confluency, and lysed for PCR-based assays. Multiple transfection methods may be used, including, but not limited to, lipofection (e.g. Lipofectamine) or nucleofection (e.g. by electroporation).

Strategies for Selecting for and/or Detecting RNA-Guided DNA Integration Events

Figure 22A:
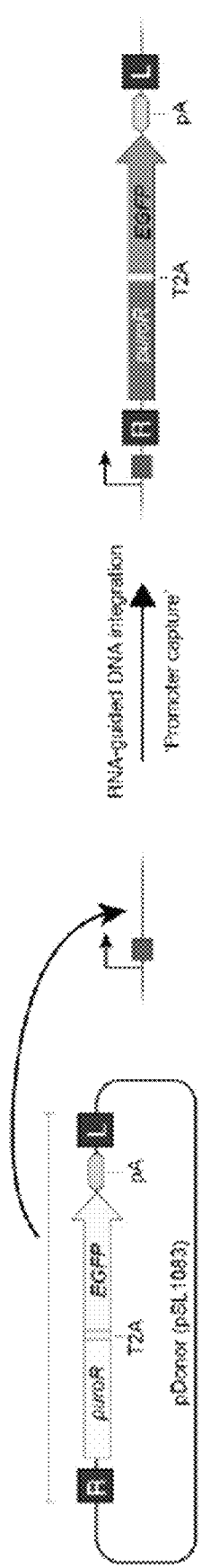
FIGS. 22A-22C are exemplary experimental strategies for selecting and/or detecting RNA-guided DNA integration in HEK293T cells.

In one embodiment, termed a 'promoter capture' assay (FIG. 22A) the genetic cargo within the transposon ends on pDonor encode an EGFP fluorescent reporter protein downstream of a puromycin resistance gene (PuroR) and 2A peptide. The expression construct contains a 5' Kozak sequence and 3' polyadenylation site, but no promoter element, such that expression of the reporter protein is absent within the pDonor context. However, upon RNA-guided DNA integration downstream of a DNA target site complementary to the gRNA, in which the integration site is downstream of an endogenous promoter element, the reporter gene becomes expressed. This expression may be selected for by culturing cells in the presence of puromycin, since only successful integration events will lead to expression of PuroR and thus puromycin resistance. Integration may also be detected using flow cytometry, by assaying an EGFP-positive cell population.

Figure 22B:
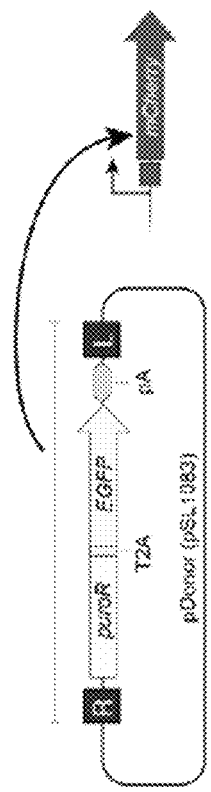

In a related embodiment, the target and/or integration site is embedded within an orthogonal fluorescence reporter gene, such as mCherry (FIG. 22B). In this case, the HEK293T cells initially express mCherry, but upon RNA-guided DNA integration, the mCherry open reading frame (ORF) is disrupted by the integration of the genetic cargo, and EGFP becomes expressed by virtue of inserting downstream of the promoter element that previously drove mCherry expression.

Thus, successful RNA-guided DNA integration manifests itself as a phenotype change from EGFP-negative/mCherry-positive to EGFP-positive/mCherry-negative. This approach may be performed by targeting mCherry encoded on pTarget, or mCherry that is genomically integrated.

Figure 22C:
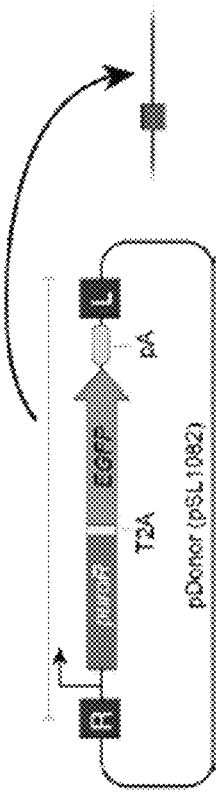
Figure 23A:
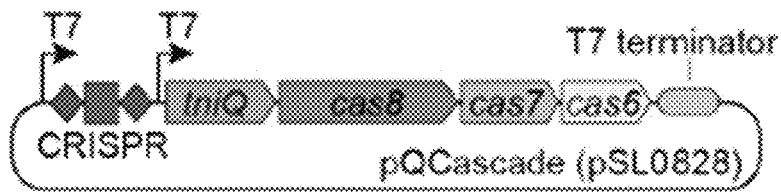
FIGS. 23A-23D are exemplary expression construct designs to reduce promoter number.
Figure 23B:
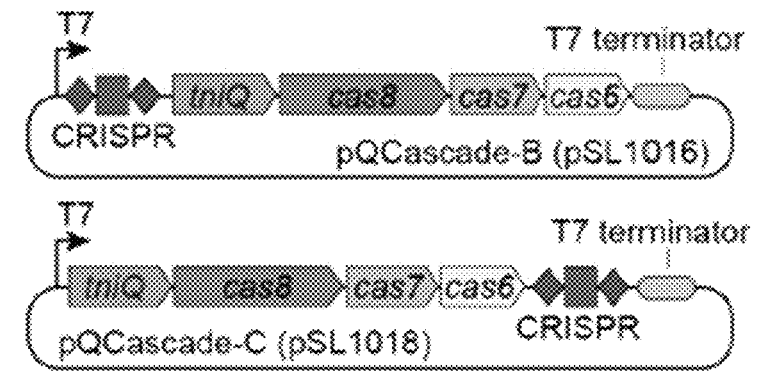
Figure 23C:
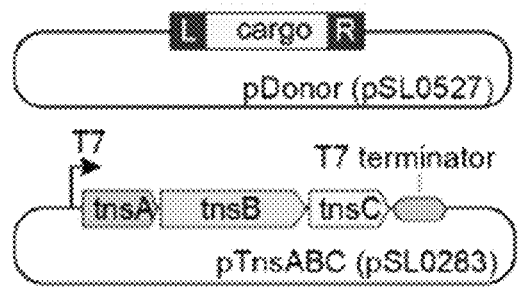
Figure 23D:
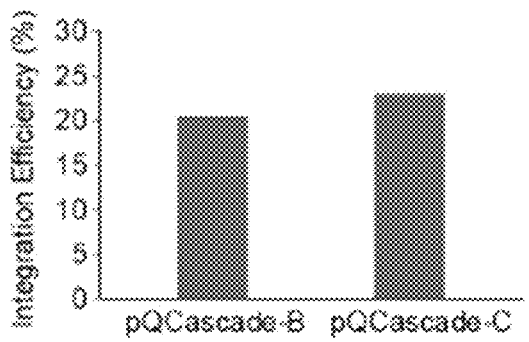

In another embodiment, pDonor contains a fluorescent reporter gene within the transposon ends, as well as its own internal promoter element (FIG. 22C). The fluorescent reporter protein is expressed from pDonor upon transfection, but the cells are cultured for a sufficiently long time, such that pDonor is eventually lost due to the transient transfection. In this scenario, the dividing cells will only maintain reporter protein expression if the integration event occurs, either within the genome, or within pTarget that also contains an SV40 origin and is thus replicated by dividing HEK293T cells.

Other embodiments leverage additional selection strategies, such as other fluorescence reporter genes and/or other drug resistance markers.

Screening of Additional gRNAs

Beyond targeting sites within mCherry, additional gRNAs are chosen to demonstrate successful RNA-guided DNA integration within alternative genomic contexts, for example, euchromatin and heterochromatin regions, coding and noncoding regions, and template and nontemplate strands within coding regions. Additional gRNAs are also chosen to screen mismatch sensitivity, PAM specificity, integration site specificity, and other parameters of the RNA-guided DNA integration reaction.

Genotypic Detection and Characterization of RNA-Guided DNA Integration in Eukaryotic Cells HEK293T cells are cultured for a certain time after transfection and may be subjected to drug selection or fluorescence-activated cell sorting (FACS), in order to enrich for a cell population that is likely to have undergone RNA-guided DNA integration. Cells are then harvested, lysed, and subjected to PCR analysis. Primer pairs are designed to selectively amplify the integrated allele, in which one primer has a binding site within the transposon genetic cargo, and another primer has a binding site within the DNA flanking the integration site; this may reside on pTarget, for plasmid-to-plasmid transposition experiments, or it may reside on the genome, for plasmid-to-genome transposition experiments. An amplicon is successfully generated by PCR in the case of an RNA-guided DNA integration event, whereas no amplicon is generated in the absence of targeted integration.

In order to determine the precise site of integration by Sanger sequencing, amplified DNA from the analytical PCR reactions described above are excised after separation by gel electrophoresis, DNA is isolated by Gel Extraction Kit (Qiagen), and samples are submitted to and analyzed by GENEWIZ. Analysis of the resulting Sanger sequencing data reveals the junction between the transposon ends (encoded by pDonor) and the targeted DNA. By analyzing this junction across experiments with multiple distinct gRNAs, and comparing the relative position of the integration site with the target site specified by the gRNA, the parameters governing the distance between the Cascade binding site (dictated by the gRNA) and the integration site (where TnsB catalyzes transposition into) in eukaryotic cells can be readily determined. Coupled with the choice of genome- and transposon cargo-specific primers, these experiments also reveal the preferred orientation of integration; namely, whether the Tn7 transposon is directed to integrate in only one orientation, or whether both orientations are sampled during the integration reaction.

In order to define the integration site with more precision, PCR amplicons are also analyzed by next-generation sequencing (NGS). PCR-1 products are generated as described above, except that primers contain universal Illumina adapters as 5' overhangs and the cycle number is reduced to 20. These products are then diluted 20-fold into a fresh polymerase chain reaction (PCR-2) containing indexed p5/p7 primers and subjected to 10 additional thermal cycles using an annealing temperature of 65° C. Amplification is verified by analytical gel electrophoresis, and barcoded reactions are pooled and resolved by 2% agarose gel electrophoresis, DNA is isolated by Gel Extraction Kit (Qiagen), and NGS libraries are quantified by qPCR using the NEBNext Library Quant Kit (NEB). Illumina sequencing is performed using a NextSeq mid output kit with 150-cycle single-end reads and automated demultiplexing and adapter trimming (Illumina). Individual bases with Phred quality scores under 20 (corresponding to a base miscalling rate of >1%) are changed to 'N,' and only reads with at least half the called bases above Q20 are retained for subsequent analysis.

To determine the integration site distribution for a given sample, the following steps are performed using custom Python scripts. First, reads are filtered based on the requirement that they contain 20-bp of perfectly matching transposon end sequence. 15 bp of sequence immediately flanking the transposon are then extracted and aligned to a 1-kb window of the DNA sequence surrounding the gRNA-matching genomic target site. The distance between the nearest transposon-genome junction and the PAM-distal edge of the 32-bp target site is determined. Histograms are plotted after compiling these distances across all the reads within a given library.

A qPCR approach is used to quantify transposition efficiency, allowing for careful comparison across large parameter space, including but not limited to different protein and/or gRNA variants, different transfection conditions, different expression construct designs, different delivery methods, and different culturing and selection methods. Pairs of transposon- and genome-specific primers are designed to amplify a ~140-240-bp fragment resulting from RNA-guided DNA integration at the expected locus in either orientation. A separate pair of genome-specific primers is designed to amplify a *Homo sapiens* reference gene for normalization purposes. qPCR reactions (10 µL) contain 5 µL of SsoAdvanced Universal SYBR Green Supermix (Bio-Rad), 1 µL $H_2O$, 2 µL of 2.5 µM primers, and 2 µL of diluted HEK293T lysate. Reactions are prepared in 384-well clear/white PCR plates (BioRad), and measurements are performed on a CFX384 Real-Time PCR Detection System (BioRad) using the following thermal cycling parameters: polymerase activation and DNA denaturation (98° C. for 2.5 min), 40 cycles of amplification (98° C. for 10 s, 62° C. for 20 s), and terminal melt-curve analysis (65-95° C. in 0.5° C./5 s increments).

In another qPCR analysis protocol, each biological sample is analyzed in three parallel reactions: one reaction contains a primer pair for the *H. sapiens* reference gene, a second reaction contains a primer pair for one of the two possible integration orientations, and a third reaction contains a primer pair for the other possible integration orientation. Transposition efficiency for each orientation is then calculated as 2ΔCq, in which ΔCq is the Cq difference between the experimental reaction and the control reaction. Total transposition efficiency for a given experiment is calculated as the sum of transposition efficiencies for both orientations.

Defining Genome-Wide Specificity of RNA-Guided DNA Integration in Eukaryotic Cells In order to probe genome-wide transposition, transposon-insertion sequencing (Tn-seq) is performed. Specifically, RNA-guided DNA integration experiments are performed as described above, except pDonor contain point mutations in the transposon ends that introduced MmeI restriction site. After extracting genomic and plasmid DNA from harvested HEK293T cells, NGS libraries are prepared in parallel on 96-well plates, as follows. First, 1 µg of gDNA is digested with 4 Units of MmeI (NEB) for 12 hours at 37° C. in a 50 µL reaction containing 50 µM S-adenosyl methionine and 1× CutSmart Buffer, prior to heat inactivation at 65° C. for 20 minutes. MmeI cleaves the transposon directly outside of the terminal repeat, leaving 2-nt 3'-overhangs.

Reactions are cleaned up using 1.8×Mag-Bind TotalPure NGS magnetic beads (Omega) according to the manufacturer's instructions, and elutions are performed using 30 µL of 10 mM Tris-Cl, pH 7.0. MmeI-digested gDNA is ligated to a double-stranded i5 universal adapter containing a terminal 5'-NN-3' overhang in a 20 µL ligation reaction containing 16.86 µL of MmeI-digested gDNA, 280 nM adapter, 400 Units of T4 DNA ligase (NEB), and 1×T4 DNA Ligase Buffer. Reactions are incubated at room temperature for 30 minutes, before being cleaned up with magnetic beads as before. To reduce the degree of pDonor contamination within the NGS libraries, since pDonor also contains the full-length transposon with an MmeI site, the presence of a unique HindIII restriction site just outside the transposon right end within pDonor is utilized. The entirety of the adapter-ligated gDNA sample is thus digested with 20 Units of HindIII (NEB) in a 34.4 µL reaction for one hour at 37° C., before a heat inactivation step at 65° C. for 20 minutes. Magnetic bead-based DNA clean-up is performed as before.

Adapter-ligated transposons are enriched in a PCR-1 step using a universal i5 adapter primer and a transposon-specific primer containing a universal i7 adapter as 5' overhang. Reactions are 25 µL in volume and contained 16.75 µL of HindIII-digested gDNA, 200 µM dNTPs, 0.5 µM primers, 1×Q5 Reaction Buffer, and 0.5 Units Q5 Hot Start High-Fidelity DNA Polymerase (NEB). Amplification is allowed to proceed for 25 cycles, with an annealing temperature of 66° C. Reaction products are then diluted 20-fold into a second 20 µL polymerase chain reaction (PCR-2) containing indexed p5/p7 primers, and this is subjected to 10 additional thermal cycles using an annealing temperature of 65° C. After verifying amplification for select libraries by analytical gel electrophoresis, barcoded reactions are pooled and resolved by 2% agarose gel electrophoresis, DNA is isolated by Gel Extraction Kit (Qiagen), and NGS libraries are quantified by qPCR using the NEBNext Library Quant Kit (NEB). Illumina sequencing is performed using a NextSeq mid output kit with 150-cycle single-end reads and automated demultiplexing and adapter trimming (Illumina). Individual bases with Phred quality scores under 20 (corresponding to a base miscalling rate of >1%) are changed to 'N,' and only reads with at least half the called bases above Q20 are retained for subsequent analysis. Analysis of Tn-seq data is performed, as described previously.

In an alternative method for determining the genome-wide specificity of RNA-guided DNA integration, genomic and plasmid DNA is purified from harvested HEK293T cells, the DNA is randomly fragmented, and then Illumina adapters are ligated onto free ends after end repair (e.g. using the NEBNext Illumina library prep kit). Then, targeted PCR is used to selectively amplify only those DNA molecules containing the transposon and genetic cargo sequence, by combining an Illumina adapter-specific primer with a transposon or cargo-specific primer. These PCR amplicons are then further amplified to append indices, and the Illumina NGS and analysis is performed generally as described above.

Example 3

Optimization and Streamlining of Expression Plasmid Construction for RNA-Guided DNA Integration in Bacterial Cells Tn7-like transposons that encode CRISPR-Cas systems can be used for programmable DNA integration, in which the nuclease-deficient CRISPR-Cas machinery (either Cascade from Type I systems, or C2c5 from Type V systems) coordinates with Tn7 transposon-associated proteins to mediate RNA-guided DNA targeting and DNA integration, respectively.

Initial experiments with the Tn7 transposon from Type IF variant *Vibrio cholerae* strain HE-45, expressed the CRISPR- and Tn7-associated molecular components from two different expression vectors driven by T7 promoters, termed pQCascade (TniQ-Cas8-Cas7-Cas6 and gRNA) and pTnsABC (TnsA-TnsB-TnsC). Cas8 is a natural fusion of Cas8 and Cas5 polypeptides, hereafter referred to simply as Cas8 in this Example for Type IF variants. The mini-transposon construct, containing a genetic cargo cloned in between the transposon left and right ends, was encoded on a third plasmid termed pDonor. See FIG. 1B.

The molecular components may also be combined into fewer plasmids without negatively affecting RNA-guided DNA integration efficiency. In one embodiment, combining all the components onto one unified cassette driven by a single promoter allows for convenient and straightforward modular designs of further expression plasmid derivations, including: the use of different promoters, such as promoters that would be recognized in many different bacterial species; the use of different plasmid backbones with variable copy numbers; and the use of conjugative plasmids that mediate transfer between phylogenetically distinct bacterial strains. Furthermore, such all-in-one single plasmids remove the need for combining multiple compatible plasmid backbones and multiple antibiotic resistance cassettes, while also streamlining the bacterial transformation process. In some embodiments, all the CRISPR- and Tn7-associated machinery are encoded on the same plasmid as the mini-transposon donor DNA itself, but are not contained within the transposon ends; in this format, the molecular components act to mobilize the donor DNA, but they do not travel with it. In other embodiments, the CRISPR- and Tn7-associated machinery are encoded directly within the mini-transposon donor DNA itself, such that mobilization of the transposon leads to mobilization of the machinery that is required for RNA-guided DNA integration. This allows the transposon to act autonomously.

Reduction of Promoter and Plasmid Components for RNA-Guided DNA Integration

Within a three-plasmid delivery approach to reconstitute RNA-guided DNA integration, the expression of the guide RNA (gRNA) and the Type IF variant TniQ-Cas8-Cas7-Cas6 operon on the original pQCascade plasmid (pSL0828) were tested with a single T7 promoter, rather than by two tandem T7 promoters (FIG. 23). The gRNA was encoded by a synthetic CRISPR array comprising a repeat-spacer-repeat array; the precursor CRISPR RNA transcript was processed enzymatically by Cas6 into the mature CRISPR RNA (crRNA), or gRNA. Two designs were generated: pQCascade-B (pSL1016) encodes the CRISPR array upstream of the TniQ-Cas8-Cas7-Cas6 operon, whereas pQCascade-C (pSL1018) encodes the TniQ-Cas8-Cas7-Cas6 operon upstream of the CRISPR array (FIGS. 23A and 23B). Chemically competent E. coli BL21(DE3) cells containing the V. cholerae pDonor (pSL0527) and pTnsABC (pSL0283) plasmids (FIG. 23C, as previously described) were individually transformed with either pQCascade-B or pQCascade-C by heat shock, and after recovering cells in fresh LB medium at 37° C., for one hour, cells were plated on triple antibiotic LB-agar plates containing 100 μg/mL carbenicillin, 50 μg/mL kanamycin, and 50 μg/mL spectinomycin. After overnight growth at 37° C. for 16 hours, hundreds of colonies were scraped from the plates, and a portion was resuspended in fresh LB medium before being re-plated on triple antibiotic LB-agar plates as before, except for supplementation with 0.1 mM IPTG to induce protein expression. Solid media culturing was chosen over liquid culturing in order to avoid growth competition and population bottlenecks. Cells were incubated an additional 24 hours at 37° C. and grew as densely spaced colonies, before being scraped, resuspended in LB medium, and prepared for subsequent analysis.

Optical density measurements at 600 nm were taken of scraped colonies that had been resuspended in LB medium, and ~3.2×10$^8$ cells (the equivalent of 200 μL of OD$_{600}$=2.0) were transferred to a 96-well plate. Cells were pelleted by centrifugation at 4000×g for 5 minutes and resuspended in 80 μL of H$_2$O, before being lysed by incubating at 95° C. for 10 minutes in a thermal cycler. The cell debris was pelleted by centrifugation at 4000×g for 5 minutes, and 10 L of lysate was removed and diluted with 90 μL of H$_2$O to generate 10-fold lysate dilutions for qPCR analysis. Pairs of transposon and genome-specific primers were designed to amplify a ~140-240-bp fragment resulting from RNA-guided DNA integration at the expected gRNA-4 lacZ locus in either orientation. A separate pair of genome-specific primers was designed to amplify an E. coli reference gene (rssA) for normalization purposes. qPCR reactions (10 μL) contained 5 μL of SsoAdvanced Universal SYBR Green Supermix (BioRad), 1 μL H$_2$O, 2 μL of 2.5 μM primers, and 2 μL of 10-fold diluted lysate prepared from scraped colonies.

Reactions were prepared in 384-well clear/white PCR plates (BioRad), and measurements were performed on a CFX384 Real-Time PCR Detection System (BioRad) using the following thermal cycling parameters: polymerase activation and DNA denaturation (98° C. for 2.5 min), 40 cycles of amplification (98° C. for 10 s, 62° C. for 20 s), and terminal melt-curve analysis (65-95° C. in 0.5° C./5 s increments).

The results from qPCR analysis (FIG. 23D) demonstrated that RNA-guided DNA integration with pQCascade-B and pQCascade-C exhibited similar efficiencies as the original pQCascade plasmid with tandem promoters previously described. Expression of both the gRNA and the Type IF variant TniQ-Cas8-Cas7-Cas6 operon can be driven by a single T7 promoter, and crRNA processing by the Cas6 subunit does not substantially affect protein synthesis.

Figure 24A:
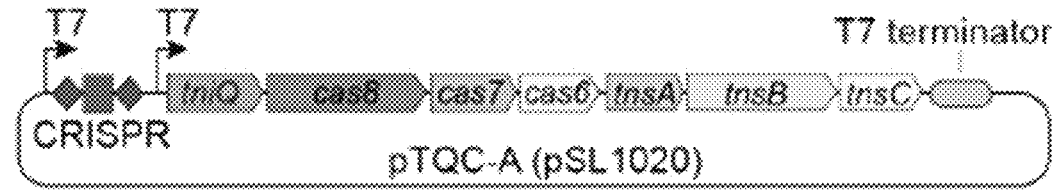
FIGS. 24A-24F are exemplary expression construct designs to express all CRISPR- and Tn7-associated machinery from one plasmid.
Figure 24B:
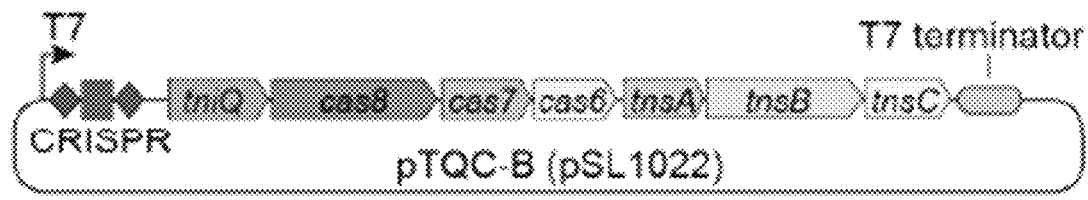
Figure 24C:
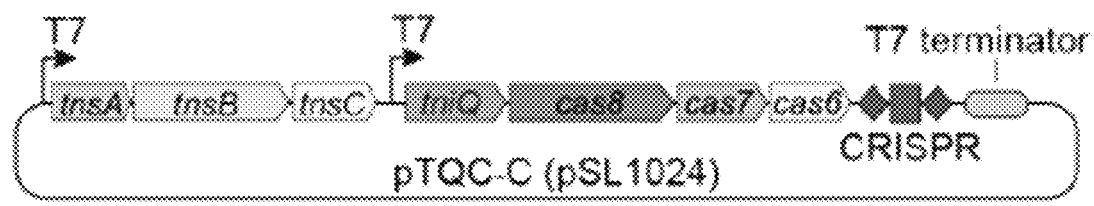
Figure 24D:
Figure 24E:
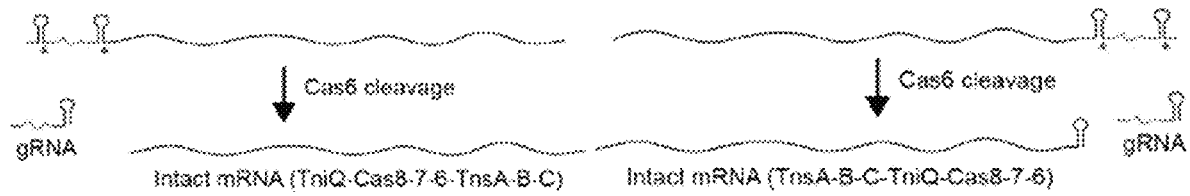
Figure 24F:
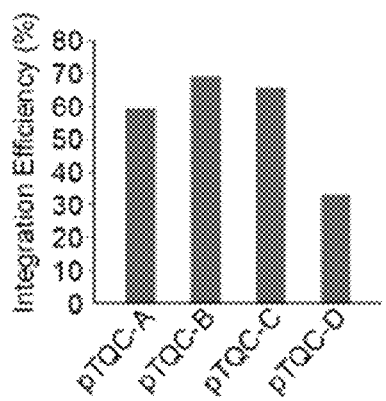

Expression and delivery conditions in which the total number of separate plasmids required for RNA-guided DNA integration was reduced to two were tested. The TnsA-TnsB-TnsC operon was expressed on the same plasmid as the gRNA and TniQ-Cas8-Cas7-Cas6 operon; denoted pTnsABC-QCascade-CRISPR, or pTQC (FIG. 24). The TnsA-TnsB-TnsC operon from pTnsABC was cloned either downstream of the TniQ-Cas8-Cas7-Cas6 operon on pQCascade (pSL0828) to generate pTQC-A (pSL1020, FIG. 24A), or upstream of the TniQ-Cas8-Cas7-Cas6 operon on pQCascade-C (pSL1018) to generate pTQC-C (pSL1024, FIG. 24C). Starting with pTQC-A, the T7 promoter in between the CRISPR and the protein operon ws removed to generate the single promoter design of pTQC-B (pSL1022, FIG. 24B). Starting with pTQC-C, the T7 promoter in between the TnsA-TnsB-TnsC operon and the TniQ-Cas8-Cas7-Cas6 operon was removed to generate the single promoter design of pTQC-D (pSL1026, FIG. 24D). Both single-promoter plasmids (pTQC-B and pTQC-D) were designed so that the CRISPR array was positioned at either the 5' or 3' end of the mRNA transcript, so that precursor CRISPR RNA processing by Cas6 would not disrupt the protein-coding genes within the mRNA, since the remaining transcript would be left intact (FIG. 24E).

Chemically competent E. coli BL21(DE3) cells containing the V. cholerae pDonor (pSL0527) were individually transformed with either pTQC-A, pTQC-B, pTQC-C, or pTQC-D by heat shock, and after recovering cells in fresh LB medium at 37° C. for one hour, cells were plated on double antibiotic LB-agar plates containing 100 μg/mL carbenicillin and 50 μg/mL spectinomycin. After overnight growth at 37° C. for 16 hours, hundreds of colonies were scraped from the plates, and a portion was resuspended in fresh LB medium before being re-plated on double antibiotic LB-agar plates as before, this time supplemented with 0.1 mM IPTG to induce protein expression. Cells were subsequently lysed, and RNA-guided DNA integration efficiencies were determined using qPCR of cell lysates as described above.

RNA-guided DNA integration efficiencies determined by qPCR (FIG. 24F) show that all four pTQC plasmid designs resulted in efficiencies comparable to, or significantly higher than, integration using the original three-plasmid system previously described (compare ~70% efficiency with pTQC-B to ~40% efficiency with the three-plasmid system utilizing pSL0828 as pQCascade). Between the two designs for single-promoter expression (pTQC-B and pTQC-D), pTQC-B demonstrates superior activity. Thus, for subsequent streamlined expression plasmid designs, the CRISPR-TniQ-Cas8-Cas7-Cas6-TnsA-TnsB-TnsC ordering of components in a single expression cassette from pTQC-B was used.

Figure 25A:
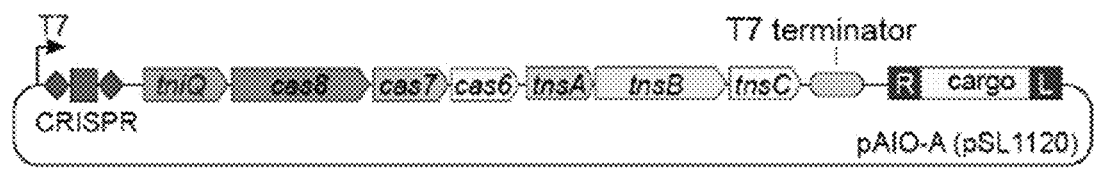
FIGS. 25A-25B are exemplary expression construct designs to express all CRISPR- and Tn7-associated machinery, as well as the mini-transposon donor, from one plasmid.
Figure 25B:

Having shown that expression of the entire set of CRISPR- and Tn7-associated components necessary for RNA-guide DNA integration can be achieved in one streamlined cassette driven by a single T7 promoter, an "all-in-one"

single plasmid approach was designed for performing RNA-guided DNA integration. In this embodiment, the streamlined *V. cholerae* cassette from pTQC-B (pSL1022) is cloned onto the pDonor plasmid (pSL0527), either outside of the minitransposon itself to generate pAIO-A (pSL1120, FIG. 25A), or inside the mini-transposon itself, to generate pAIO-B (pSL1123, FIG. 25B). Chemically competent *E. coli* BL21(DE3) cells are transformed with either pAIO-A or pAIO-B by heat shock, and cells are plated on single antibiotic LB-agar plates containing 100 µg/mL carbenicillin. After overnight growth at 37° C. for 16 hours, hundreds of colonies are scraped from the plates, and a portion is resuspended in fresh LB medium before being re-plated on antibiotic LB-agar plates as before, this time supplemented with 0.1 mM IPTG to induce protein expression. Subsequent lysis and qPCR assays are performed as described above in order to determine the transposition efficiencies of the pAIO plasmids. Successful RNA-guided DNA integration with this approach enables transformation of *E. coli* or other bacterial species to be accomplished with just a single expression vector, which comprises all the necessary CRISPR-Tn7 machinery and donor DNA to direct RNA-guided DNA integration.

Optimization of Promoter and Vector Copy Number for RNA-Guided DNA Integration

After validating the baseline RNA-guided DNA integration activity of the *Vibrio cholerae* CRISPR-Tn7 system using the all-in-one pAIO-A plasmid design (pSL1120, FIG. 25A), the optimal expression level of the system is determined by simultaneously varying the strength of the single promoter driving expression of the entire cassette, in parallel with varying the copy number of the all-in-one plasmid. This series of experiments highlights the modularity of the all-in-one design: with the pAIO-A plasmid as a starting point, different promoters and plasmid backbones can be cloned and compared in parallel.

Figure 26A:
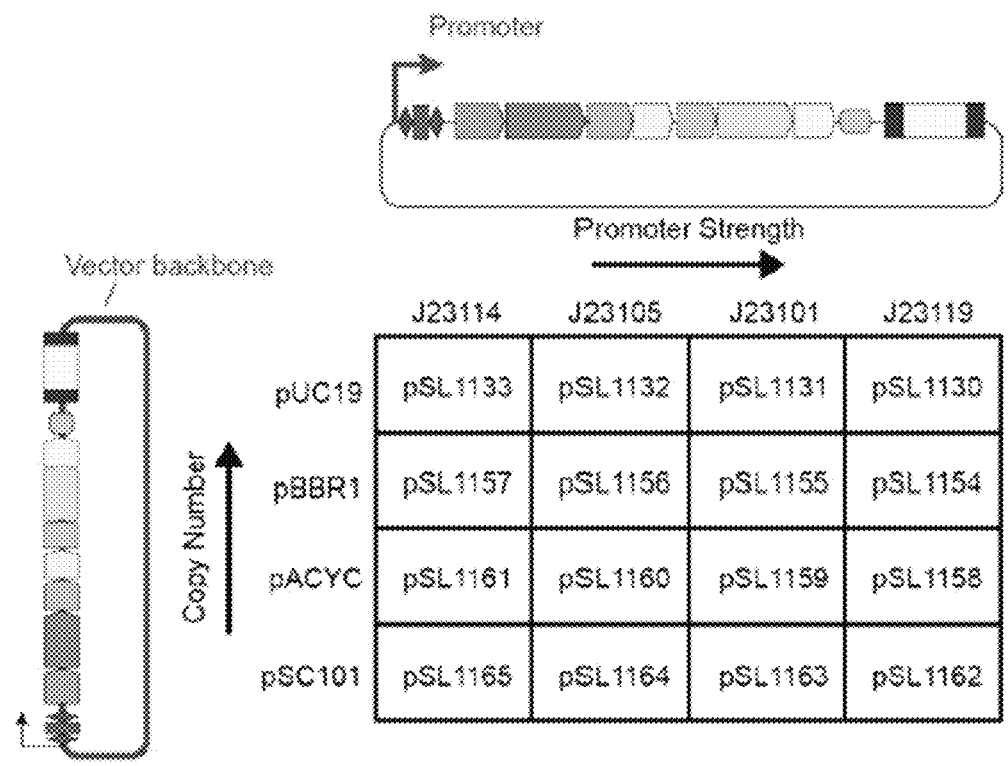
FIGS. 26A-26B are exemplary expression construct designs to optimize promoter strength, plasmid copy number, and cargo size for all-in-one RNA-guided DNA integration experiments.

The set of pAIO plasmid designs is generated and cloned within the pUC19 parent vector backbone, with CRISPR-Tn7 expression driven by each of four distinct constitutive *E. coli* promoters of decreasing strengths: J23119, J23101, J23105 and J23114. These promoters are derived from the Registry of Standard Biological Parts and have been previously validated (Yan, Q. & Fong, S. S. *J Biol Eng* 11, 33 (2017)). In other embodiments, a greater set of promoters are also tested, combined with further changes to the precise expression construct, include gene order, untranslated region (UTR) design, and codon usage, among other parameters. Each of the complete cassettes is cloned onto 3 other parent plasmid backbones: pSC101 (~5 copies/cell), pACYC (~10-12 copies/cell), and pBBR1 (~15-40 copies/cell), to generate a panel of 16 all-in-one plasmids that combine four promoter strengths with four copy number levels (FIG. 26A). The RNA-guided DNA integration efficiency enabled with each plasmid design is tested in *E. coli* BL21(DE3) cells *E. coli* and determined by qPCR, as described above. In other embodiments, a greater set of parent vector backbones is tested, including conjugative plasmids, plasmids whose replication is restricted to certain *E. coli* strains, and temperature-sensitive plasmids that can be cured from a population of bacteria.

Figure 26B:
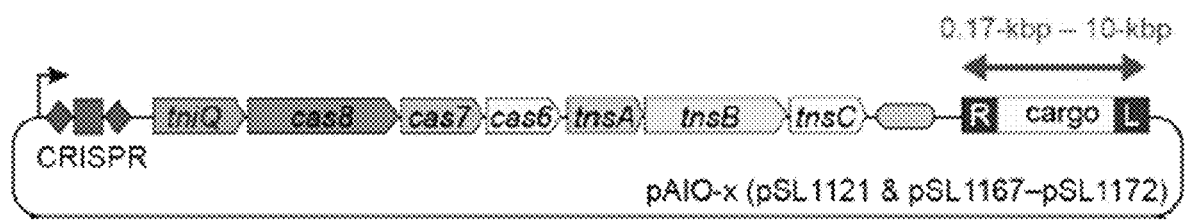
Figure 27:
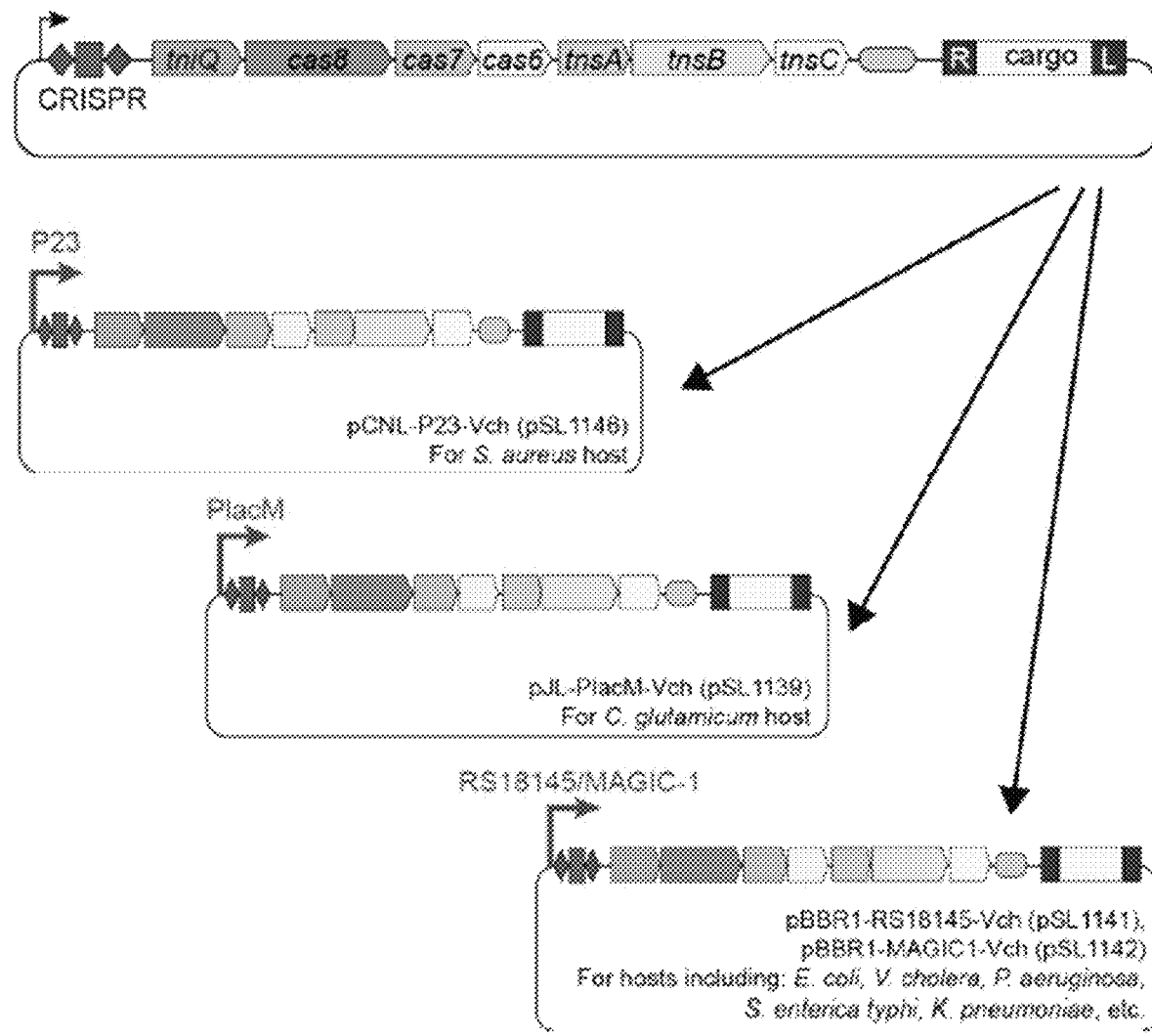
FIG. 27 is an exemplary promoter strategy for expression and reconstituting RNA-guided DNA integration in select heterologous hosts. The all-in-one expression vector, pAIO-A (pSL1120) is further modified to carry alternative promoters (red) that are recognized and expressed in various other expression hosts, denoted in italics. In one embodiment (bottom right), the chosen promoter has broad host range activity and can be recognized in various known human commensal and pathogenic bacteria. In further embodiments, additional promoters are selected to match additional host bacterial species of interest.

In order to determine the limits to the cargo size that can be efficiently mobilized by the all-in-one expression approach using pAIO-A, the 0.98 kb original cargo on pAIO-A is replaced with cargo sequences of various lengths that have been described previously in the three-plasmid approach: 2.00 kb (pSL1168), 3.26 kb (pSL1169), 4.24 kb (pSL1170), 5.32 kb (pSL1171), and 10.1 kb (pSL1172; see FIG. 26B). The transposition efficiencies for the 5 and 10 kb cargos, which have potential for industrial applications such as insertion of metabolic pathways, have been previously shown to drop to less than 15% of the efficiencies of the 0.98 kb cargo in the three-plasmid system; however, using the more efficient all-in-one approach may improve these efficiencies for larger cargos. A "minimal" cargo comprising 172-bp and the necessary transposon end sequences, as previously described, is also tested for RNA-guided DNA integration efficiency.

RNA-Guided DNA Integration in Other Bacterial Species

With the optimization and streamlining of expression and delivery described above, the CRISPR-Tn7 system may be further leveraged to achieve RNA-guided DNA integration in other bacterial hosts, with a focus on both industrial biotechnology applications, and on targeting of clinically and biomedically relevant human pathogenic bacterial species. Starting with all-in-one plasmids in which the vector backbone is chosen to show broad host range compatibility with the bacterial species being targeted, the single promoter is swapped out with additional promoters that are chosen to match the species of interest. Further promoters may be selected that are known to be broadly active in phylogenetically distinct bacteria, such as the diverse bacteria that inhabit the gut microbiome (Johns et al. *Nat Meth* 15, 323-329 (2018); Ronda et al. *Nat Meth* 16, 167-170 (2019)). A list of candidate bacterial species and strains that may be selected for heterologous RNA-guided DNA integration experiments is listed in Table 1; some *E. coli* strains are chosen as model strains that are known to be deficient in homologous recombination (HR), so that experiments are performed to show that RNA-guided DNA integration with CRISPR-Tn7 does not rely on any HR host factors. In other embodiments, additional promoters are selected, and additional bacterial species are selected for heterologous reconstitution of RNA-guided DNA integration with the CRISPR-Tn7 system.

TABLE 1

Potential bacterial species and strains for heterologous RNA-guided DNA integration

| Phylum | Genus | Species | Serovar | Strain | Gram Stain | Relevant Mutation(s) |
| --- | --- | --- | --- | --- | --- | --- |
| Proteobacteria | *Escherichia* | coli | N/A | MG1655 | Negative | None |
| Proteobacteria | *Escherichia* | coli | N/A | BW25113 | Negative | None |
| Proteobacteria | *Escherichia* | coli | N/A | JS2669-1 | Negative | RecA knockout |
| Proteobacteria | *Escherichia* | coli | N/A | JW2788-1 | Negative | RecB knockout |
| Proteobacteria | *Escherichia* | coli | N/A | JW2790-1 | Negative | RecC knockout |

TABLE 1-continued

Potential bacterial species and strains for heterologous RNA-guided DNA integration

| Phylum | Genus | Species | Serovar | Strain | Gram Stain | Relevant Mutation(s) |
|---|---|---|---|---|---|---|
| Proteobacteria | Escherichia | coli | N/A | JW2787-1 | Negative | RecD knockout |
| Proteobacteria | Escherichia | coli | N/A | JW3677-1 | Negative | RecF knockout |
| Proteobacteria | Escherichia | coli | N/A | JW2703-2 | Negative | MutS knockout |
| Proteobacteria | Escherichia | coli | N/A | ER | Negative | AsnA, asnB knockout |
| Firmicutes | Bacillus | subtilis | N/A | 168 | Positive | None |
| Proteobacteria | Vibrio | cholerae | O1 | ElTor N19691 | Negative | None |
| Proteobacteria | Pseudomonas | aeruginosa | N/A | PA01 | Negative | None |
| Proteobacteria | Pseudomonas | aeruginosa | N/A | PAK | Negative | None |
| Proteobacteria | Salmonella | enterica | typhi | ty2 | Negative | None |
| Proteobacteria | Klebsiella | pneuomoniae | N/A | KPPR1 | Negative | None |
| Firmicutes | Staphylococcus | aureus | N/A | RN4220 | Positive | None |
| Actinobacteria | Corynebacterium | glutamicum | N/A | ATCC 13032 | Positive | None |

Example 4

Figure 28:
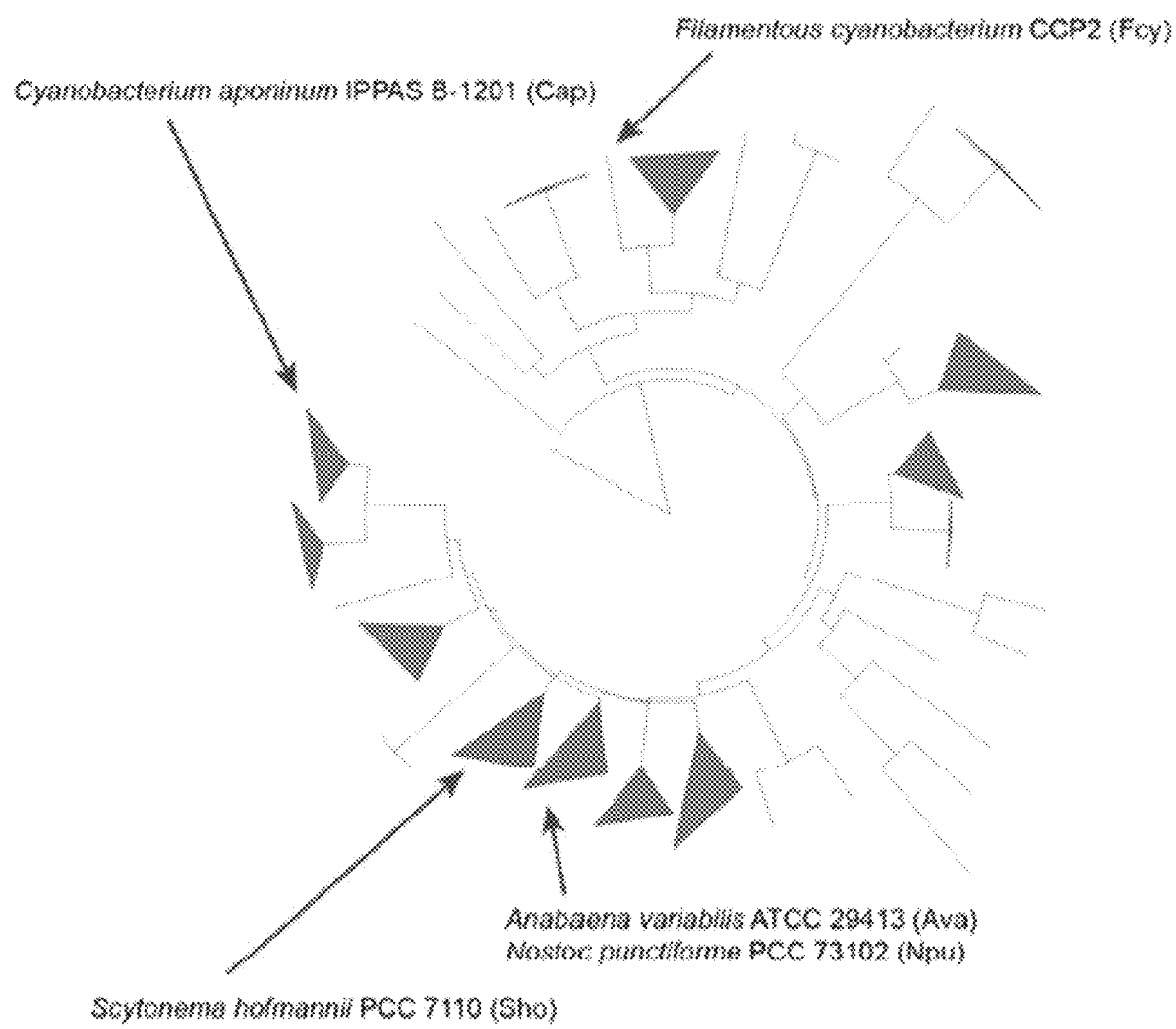
FIG. 28 is the bioinformatic analysis of C2c5 homologs. After performing a multiple sequence alignment of C2c5 proteins, phylogenetic trees were constructed and visualized using the Interactive Tree of Life. Based on numerous criteria, including sequence diversity, genetic architecture, and readily identifiable transposon end sequences, five homologs and their associated Tn7-like transposon components were selected for further experimental investigation, labeled with the bacterial species information and highlighted with red arrows.

RNA-Guided DNA Integration Using Tn7-Like Transposons that Encode and are Programmed by Type V CRISPR-Cas Systems System Selection A psi-BLASTp analysis using the C2c5 protein from *Geminocystis* sp. NIES-3709 as a query (NCBI accession ID: WP_066116114.1) was performed. After 2 iterations, a list of 403 candidate C2c5 homologs distributed throughout various bacterial phyla (see SEQ ID NOs: 450-847) was compiled. From a multiple sequence alignment of these homologs, a phylogenetic tree was generated and homologs were prioritized for further analysis and investigation that were distributed throughout the phylogenetic tree (see FIG. 28). A set of 20 homologs were prioritized for further analysis. First, pairwise sequence alignments were performed between the 20 homologs, in order to avoid selecting any two homologs for further testing that were highly similar, and thus, expected to have similar function. The genomic loci surrounding each c2c5 gene was investigated, and the following parameters were extracted (see FIGS. 57 and 58): the presence and length of the flanking CRISPR array; the length of the C2c5 gene; whether the Tn7-like transposon encoding c2c5 appears to be integrated proximal to a tRNA gene; whether c2c5 is flanked by a merR gene; the nature of the genetic cargo that is also contained within the putative Tn7-like transposon; the length of the Tns operon (which consists of TnsB, TnsC, and TniQ; any other peculiarities of the system. Criteria that excluded a given system from being prioritized for experimental study included gene/operon lengths that deviated largely from the average, or the absence of critical components such as the CRISPR array. merR was frequently found adjacent to the c2c5 gene. Based on this gene being annotated as encoding a transcriptional regulator, merR may control expression of C2c5 and serve as a point of regulation.

Figure 29:
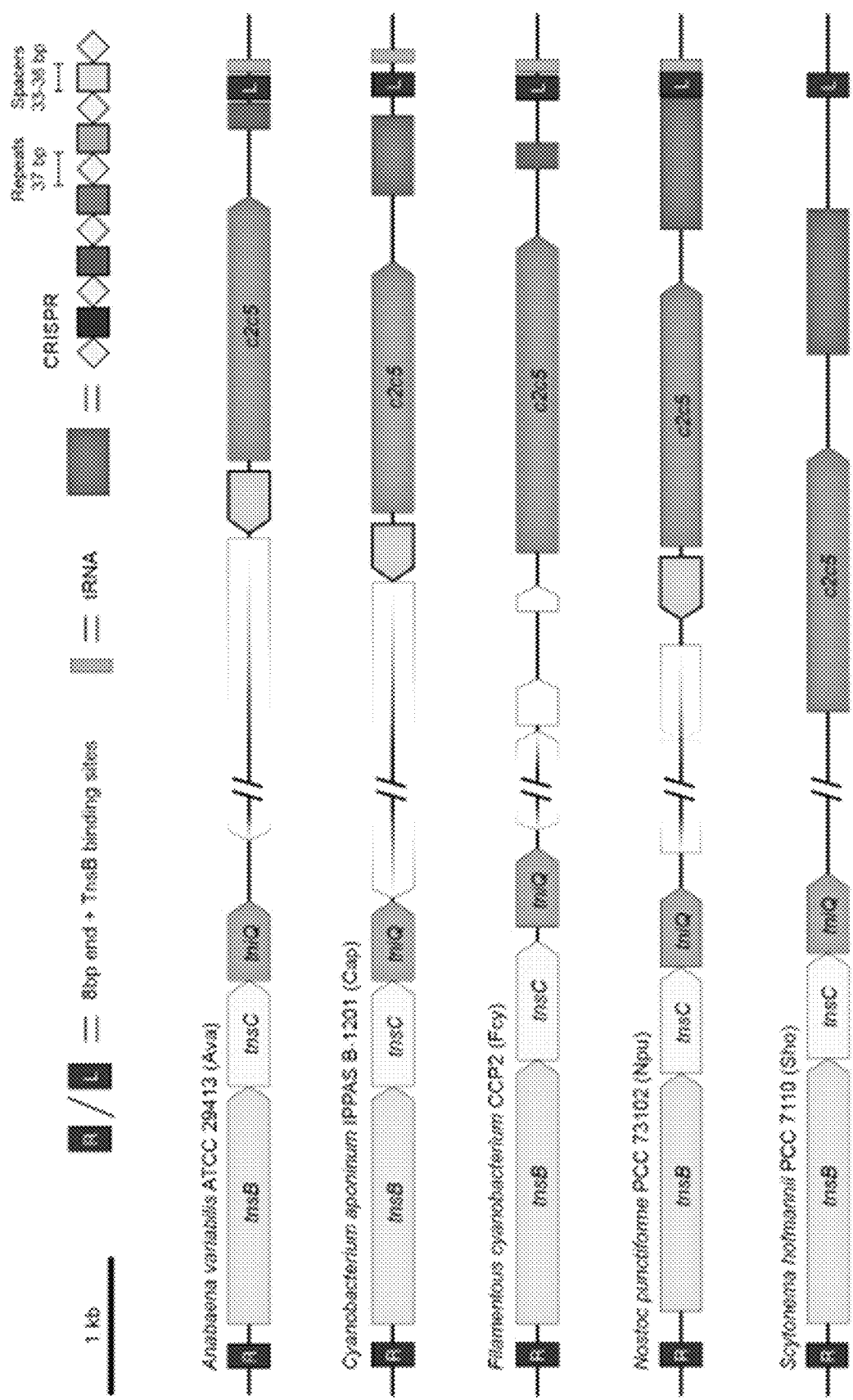
FIG. 29 is the genetic architecture of Tn7-like transposons that harbor Type V-U5 CRISPR-Cas systems encoding C2c5. Representative genomic loci from five selected bacterial species are shown. Tn7-like transposon ends (dark blue rectangles), the Tn7-associated genes tnsB-tnsC-tniQ (shades of yellow), CRISPR arrays (maroon), and the CRISPR-associated gene c2c5 (blue) are indicated. As with Type I CRISPR-Cas system-containing Tn7 transposons, Type V CRISPR-Cas system-containing Tn7-like transposons overwhelming harbor genes associated with innate immune system functions, such as restriction-modification systems. C2c5 genes are frequently flanked by the predicted transcriptional regulator, merR (grey), and the C2c5-containing Tn7-like transposons appear to almost always fall just upstream of tRNA genes (green), a phenomenon that has also been observed for other prokaryotic integrative elements. 10134

Based on the analyses, a selection of five transposon-associated Type V CRISPR-Cas systems was made. These systems derive from: *Anabaena variabilis* ATCC 29413 (Ava), *Cyanobacterium aponinum* IPPAS B-1202 (Cap), *Filamentous cyanobacterium* CCP2 (Fcy), *Nostoc punctiforme* PCC 73102 (Npu), and *Scytonema hofmannii* PCC 7110 (Sho). A schematic of the gene organization for these systems is shown in FIG. 29. Note that *Anabaena variabilis* ATCC 29413 appears to also be referred to by a different species name, *Trichormus variabilis* ATCC 29413 (see GenBank CP000117.1).

Cloning Approach

Figure 30A:
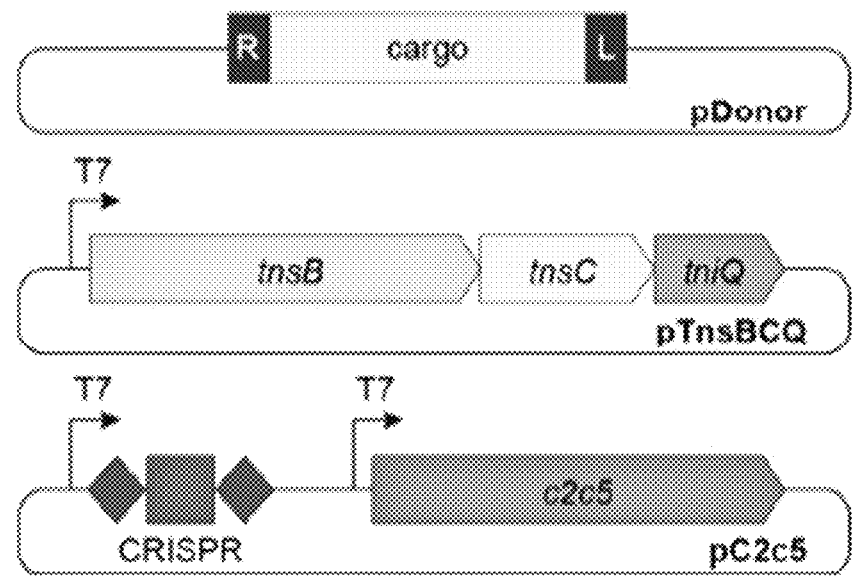
FIGS. 30A-30B show an exemplary experimental set-up to study RNA-guided DNA integration by C2c5-containing Tn7-like transposon.

For initial experiments, operons encoding tnsB, tnsC, and tniQ were synthesized and cloned downstream of a T7 promoter in the pCOLADuet-1 backbone, hereafter referred to as pTnsBCQ. The c2c5 gene and a CRISPR consisting of two repeats and a single spacer were cloned downstream of separate T7 promoters in the entry vector pCDFDuet-1, hereafter referred to as pC2c5. The Tn7-like transposon ends and a chloramphenicol resistance gene were cloned as cargo into pUC19, hereafter referred to as pDonor. A schematic of pTnsBCQ, pC2c5, and pDonor is presented in FIG. 30A, and the actual plasmid sequences for each of these plasmids, for each of the 5 systems prioritized for experimental investigation can be found in FIG. 57. The sequences for each gene and the resulting protein component can be found in SEQ ID NOs: 410-449.

Transposition Assays

Figure 30B:
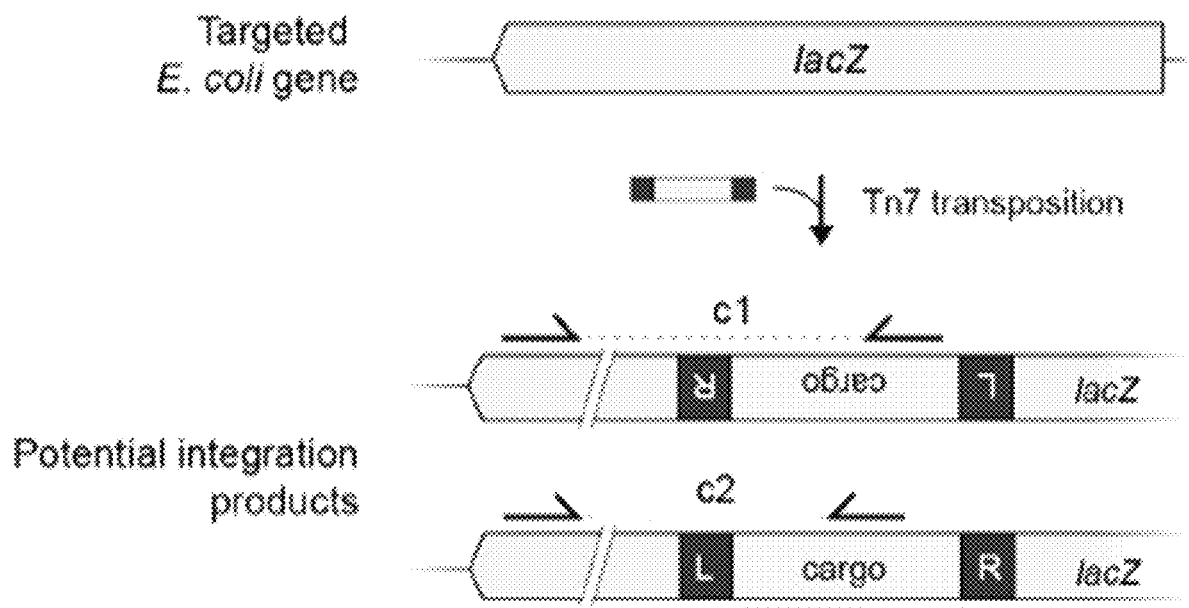

The same experimental set-up as used for RNA-guided DNA integration by the TniQ-Cascade complex in the *V. cholerae* Type I-F CRISPR-Cas system was used to test the selected Tn7-like transposons that encode C2c5 systems (schematized in FIG. 30B). In brief, chemically competent BL21(DE3) cells harboring two out of three plasmids used in the final transposition assays (pTnsBCQ, pC2c5, and pDonor) were prepared. The third plasmid was introduced in a new transformation reaction by heat shock, and after recovering cells in fresh LB medium at 37° C. for one hour, cells were plated on triple antibiotic LB-agar plates containing 100 µg/mL carbenicillin, 50 µg/mL kanamycin, and 50 µg/mL spectinomycin. After overnight growth at 37° C. for 16 hours, hundreds of colonies were scraped from the plates, and a portion was resuspended in fresh LB medium before being re-plated on triple antibiotic LB-agar plates as before, supplemented with 0.1 mM IPTG to induce protein expression. Cells were incubated an additional 24 hours at 37° C. before being scraped and resuspended in LB medium. Aliquots were taken so that each sample contains ~3.2×10$^8$ cells (based on optical density measurements) and cells were pelleted by centrifugation at 4000×g for 5 minutes, resuspended in 80 µL of H$_2$O, before being lysed by incubating at 95° C. for 10 minutes in a thermal cycler. The cell debris was pelleted by centrifugation at 4000×g for 5 minutes, and 10 µL of lysate was used for serial dilution with 90 µL of H$_2$O to generate 10- and 100-fold lysate dilutions for qPCR and PCR analysis, respectively. PCR products were generated with Q5 Hot Start High-Fidelity DNA Polymerase (NEB) using 5 µL of 100-fold diluted lysate per 12.5 µL reaction volume serving as template. Reactions contained 200 µM dNTPs and 0.5 µM primers, and were generally subjected to 30 thermal cycles with an annealing temperature of 66° C. Primer pairs contained one genome-specific primer and one transposon-specific primer, to exclusively detect integration events. PCR amplicons were resolved by 1-2% agarose gel electrophoresis and visualized by staining with SYBR Safe (Thermo Scientific).

Similar to previous experiments with the *V. cholerae* Tn7 transposon encoding a Type I-F variant CRISPR-Cas system, the integration site of the C2c5-containing Tn7-like transposons was reprogrammed by changing the spacer sequence within the CRISPR array, in order to encode a gRNA with distinct target specificity. By cloning different spacer sequences into pC2c5, integration was directed to the lacZ gene in the *E. coli* BL21(DE3) genome (see Table 2). Type V systems, in general, have a preference for T-rich PAMs and, therefore, 'TTT', 'TTG', 'TTC', and 'TTTT' (SEQ ID NO: 385) PAMs were initially tested. Additional PAM variants may also be viable as PAM recognition can be somewhat promiscuous, depending on the Cas protein variant.

Figure 31A:
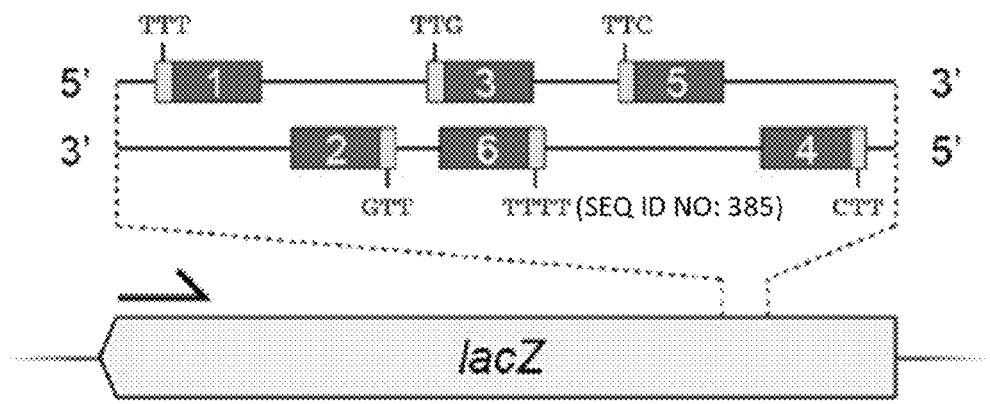
FIGS. 31A-31B are the experimental data demonstrating transposition with the Tn7-like transposon from Cyanobacterium aponinum IPPAS B-1202 (Cap).
Figure 31B:
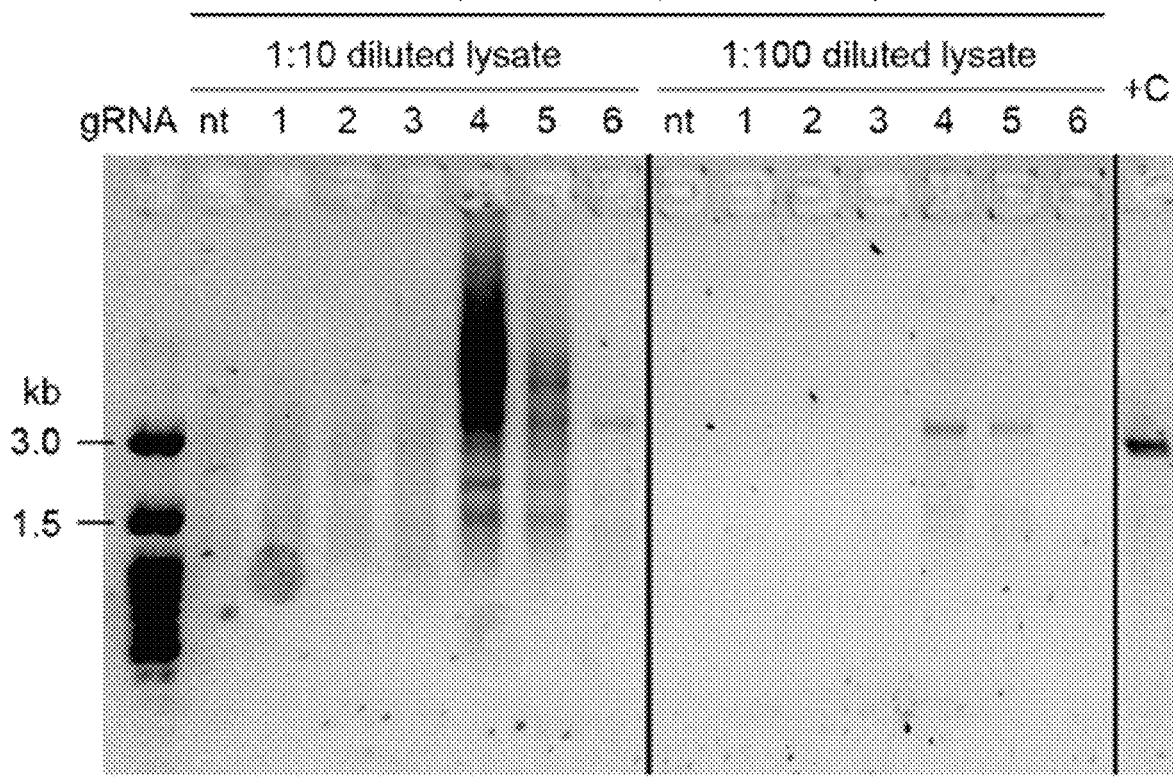

Preliminary data for the Tn7-like transposon from *Cyanobacterium aponinum* IPPAS B-1202 (Cap) is shown in FIGS. 31A and 31B. The presence of specific amplicons in the experimental samples (lanes 4-5), but an absence of specific amplicons in the negative control lane, in which the spacer was replaced with non-targeting sequence that does not have a match in the *E. coli* genome, indicated that DNA integration is occurring proximal to the lacZ primer binding site. The positive control on the same gel (+C) was the transposition product from experiments with the *V. cholerae* Tn7 transposon guided by TniQ-Cascade programmed with gRNA-4, which was in the immediate vicinity of the DNA sites targeted with the panel of gRNAs tested with C2c5 in these experiments.

Defining the Integration Site for Transposition Mediated by C2c5

In order to determine the precise site of integration by Sanger sequencing, amplified DNA from the analytical PCR reactions described above are excised after separation by gel electrophoresis, DNA is isolated by Gel Extraction Kit (Qiagen), and samples are submitted to and analyzed by GENEWIZ. Analysis of the resulting Sanger sequencing data reveals the junction between the mini-Tn7-like transposon (encoded by pDonor) and the *E. coli* genome. By analyzing this junction across experiments with multiple distinct gRNAs, and comparing the relative position of the integration site with the target site specified by the gRNA, the parameters governing the distance between the C2c5 binding site (dictated by the gRNA) and the integration site (where TnsB catalyzes transposition into) can be readily determined. Coupled with the choice of genome- and transposon cargo-specific primers, these experiments also identify the preferred orientation of integration; namely, whether the Tn7-like transposon guided by C2c5-gRNA is directed to integrate in only one orientation, or whether both orientations are sampled during the integration reaction.

In order to define the integration site with more precision, PCR amplicons are also analyzed by next-generation sequencing (NGS). PCR-1 products are generated as described above, except that primers contain universal Illumina adapters as 5' overhangs and the cycle number is reduced to 20. These products are then diluted 20-fold into a fresh polymerase chain reaction (PCR-2) containing indexed p5/p7 primers and subjected to 10 additional thermal cycles using an annealing temperature of 65° C. Amplification is verified by analytical gel electrophoresis, and barcoded reactions are pooled and resolved by 2% agarose gel electrophoresis, DNA is isolated by Gel Extraction Kit (Qiagen), and NGS libraries are quantified by qPCR using the NEBNext Library Quant Kit (NEB). Illumina sequenc-

TABLE 2

Sequence of DNA sites targeted by unique C2c5 gRNAs, all found within the lacZ gene in *E. coli*

| Target ID | Description | PAM (5'→3') | Spacer (5'→3') |
|---|---|---|---|
| nt | C2c5, BsaI stuffer, non-targeting | — | CGAGACCTCAATTGGTCTCC (SEQ ID NO: 386) |
| 1 | C2c5, lacZ sense, TTT PAM (lacZ-1) | GTTT (SEQ ID NO: 380) | CACCCTGCCATAAAGAAACTGTTACCCGTAGGTAGTC (SEQ ID NO: 387) |
| 2 | C2c5, lacZ antisense, TTG PAM (lacZ-2) | GTTG (SEQ ID NO: 381) | CCACTCGCTTTAATGATGATTTCAGCCGCGCTGTACT (SEQ ID NO: 388) |
| 3 | C2c5, lacZ sense, TTG PAM (lacZ-3) | TTTG (SEQ ID NO: 382) | TGTAGTCGGTTTATGCAGCAACGAGACGTCACGGAAA (SEQ ID NO: 389) |
| 4 | C2c5, lacZ antisense, TTC PAM (lacZ-4) | TTTC (SEQ ID NO: 383) | ATCTGTGGTGCAACGGGCGCTGGGTCGGTTACGGCCA (SEQ ID NO: 390) |
| 5 | C2c5, lacZ sense, TTC PAM (lacZ-5) | CTTC (SEQ ID NO: 384) | CAGATAACTGCCGTCACTCCAGCGCAGCACCATCACC (SEQ ID NO: 391) |
| 6 | C2c5, lacZ antisense, TTTT PAM (lacZ-6) | TTTT (SEQ ID NO: 385) | CCGTGACGTCTCGTTGCTGCATAAACCGACTACACAA (SEQ ID NO: 392) | ing is performed using a NextSeq mid output kit with 150-cycle single-end reads and automated demultiplexing and adapter trimming (Illumina). Individual bases with Phred quality scores under 20 (corresponding to a base miscalling rate of >1%) are changed to 'N,' and only reads with at least half the called bases above Q20 are retained for subsequent analysis.

To determine the integration site distribution for a given sample, the following steps are performed using custom Python scripts. First, reads are filtered based on the requirement that they contain 20-bp of perfectly matching transposon end sequence. 15 bp of sequence immediately flanking the transposon are then extracted and aligned to a 1-kb window of the E. coli BL21(DE3) genome (GenBank accession CP001509) surrounding the gRNA-matching genomic target site. The distance between the nearest transposon-genome junction and the PAM-distal edge of the 37-bp target site is determined. Histograms are plotted after compiling these distances across all the reads within a given library.

These analyses define the distance between the DNA target site specified by the gRNA, and the integration site where the transposon itself is integrated. Experiments are performed for the five different C2c5-encoding Tn7-like transposons described above, across a panel of unique gRNAs targeting a variety of distinct target sites with distinct protospacer adjacent motifs (PAMs).

qPCR Analysis of Transposition Efficiency

In order to quantify transposition efficiency, allowing for careful comparison across different protein and/or gRNA variants, a qPCR approach is used. Pairs of transposon- and genome-specific primers are designed to amplify a ~140-240-bp fragment resulting from RNA-guided DNA integration at the expected locus in either orientation. A separate pair of genome-specific primers is designed to amplify an E. coli reference gene (rssA) for normalization purposes. qPCR reactions (10 µL) contain 5 µL of SsoAdvanced Universal SYBR Green Supermix (BioRad), 1 µL H$_2$O, 2 µL of 2.5 µM primers, and 2 µL of 10-fold diluted lysate prepared from scraped colonies, as described for the PCR analysis above. Reactions are prepared in 384-well clear/white PCR plates (BioRad), and measurements are performed on a CFX384 Real-Time PCR Detection System (BioRad) using the following thermal cycling parameters: polymerase activation and DNA denaturation (98° C. for 2.5 min), 40 cycles of amplification (98° C. for 10 s, 62° C. for 20 s), and terminal melt-curve analysis (65-95° C. in 0.5° C./5 s increments).

In order to benchmark the qPCR assay, lysates are prepared from a control BL21(DE3) strain containing pDonor and both empty expression vectors (pCOLADuet-1 and pCDFDuet-1), and from strains that undergo clonal integration into the lacZ locus. By testing the primer pairs with each of these samples diluted across five orders of magnitude, and then determining the resulting Cq values and PCR efficiencies, the experimental and reference amplicons are verified as amplified with similar efficiencies, and that the primer pairs selectively amplify the intended transposition product. Variable transposition efficiencies across five orders of magnitude (ranging from 0.002-100%) are simulated by mixing control lysates and clonally-integrated lysates in various ratios, and is used to show accurate and reproducible detection of transposition products in either orientation, at levels >0.01%. Variable integration orientation biases are simulated by mixing clonally-integrated lysates together in varying ratios together with control lysates, and use this to show that these can also be accurately measured.

In another qPCR analysis protocol, each biological sample is analyzed in three parallel reactions: one reaction contains a primer pair for the E. coli reference gene, a second reaction contains a primer pair for one of the two possible integration orientations, and a third reaction contains a primer pair for the other possible integration orientation. Transposition efficiency for each orientation is then calculated as $2^{\Delta Cq}$, in which $\Delta Cq$ is the Cq difference between the experimental reaction and the control reaction. Total transposition efficiency for a given experiment is calculated as the sum of transposition efficiencies for both orientations.

Defining the Genetic Requirements of RNA-Guided DNA Integration by Tn7-Like Transposons that Encode C2c5

In order to define the essential requirements for RNA-guided DNA integration with Tn7-like transposons that encode C2c5, pTnsBCQ and pC2c5 are altered so that each gene (tnsB, tnsC, tniQ, and c2c5) is deleted one at a time. The PCR and qPCR assays described above are then used to quantify transposition efficiency for each altered plasmid that lacks one of the key genes. In cases where transposition efficiency drops to or close to 0%, these data indicate that the gene deleted in that experiment is essential for RNA-guided DNA integration by that particular Tn7-like transposon. The role of individual genes can be tested by including point mutations in tnsB predicted to abrogate transposon excision and integration enzymatic activities, or mutations in the zinc finger domain of TniQ, or mutations in the regions of C2c5 predicted to be involved in DNA binding. A resulting drop in transposition efficiency may indicate that these protein products are likely necessary for efficient RNA-guided DNA integration.

In a further series of experiments, the transposon ends for each Tn7-like transposon tested is systematically truncated, in order to define the minimum essential recognition sequences that are required for faithful recognition of the engineered transposon by Tn7-associated proteins. For example, putative TnsB binding sites can be readily identified by manual inspection of the inverted repeat nature of both the transposon left and right ends, and removal of these binding sites may cause a drop in transposition efficiency. By truncating the transposon ends in 1-, 5- and 10-bp increments, a minimal transposon end sequence can be experimentally defined. This information guides the future engineering of the transposon for development of RNA-guided DNA integration-based tools. These experiments are carried out for each of the Tn7-like transposons encoding C2c5 that show RNA-guided DNA integration activity.

An additional experiment involves defining the cargo size that can be effectively mobilized by the Tn7- and CRISPR-associated machinery. Starting with pDonor for each of the active systems, the internal cargo is either shortened through molecular cloning, or lengthened by cloning additional cargo sequences inside of the transposon ends, and the transposition assays described above are repeated. By using PCR and/or qPCR as a read-out for RNA-guided DNA integration, the relative efficiencies for each of the engineered mini-Tn7-like transposon cargos can be compared. These experiments define both the minimum and maximum genetic payload that can be mobilized by the system of interest.

Determining the Precise gRNA Molecule that Directs DNA Binding by C2c5

To analyze the nucleic acid component that directs DNA binding by C2c5, small-RNA sequencing from E. coli lysates that undergo transposition is performed. Specifically, nucleic acids of a specific size range (e.g. <100, <90, <80, <70, or <60-nt) are resolved by gel electrophoresis (10% denaturing urea-PAGE), visualized by staining with SYBR Gold (Thermo Scientific), extracted from the gel, eluted into aqueous buffer, and isolated by phenol-chloroform extraction. Analytical RNase and DNase digestions are performed in 10 µL reactions with ~4 pmol nucleic acid and either 10 µg RNase A (Thermo Scientific) or 2 Units DNase I (NEB), and are analyzed by 10% denaturing urea-PAGE and SYBR Gold staining. RNA-seq is performed generally as described (Heidrich, N., et al., *Methods Mol Biol* 1311, 1-21 (2015)). Briefly, RNA is 5'-phosphorylated/3'-dephosphorylated using T4 polynucleotide kinase (NEB), followed by clean-up using the ssDNA/RNA Clean & Concentrator Kit (Zymo Research). A ssDNA universal Illumina adapter containing 5'-adenylation and 3'-dideoxycytidine modifications is ligated to the 3' end with T4 RNA Ligase 1 (NEB), followed by hybridization of a ssDNA reverse transcriptase primer and ligation of ssRNA universal Illumina adapter to the 5' end with T4 RNA Ligase 1 (NEB). cDNA is synthesized using Maxima H Minus Reverse Transcriptase (Thermo Scientific), followed by PCR amplification using indexed p5/p7 primers. Illumina sequencing is performed using a NextSeq mid output kit with 150-cycle single-end reads and automated demultiplexing and adapter trimming (Illumina). Individual bases with Phred quality scores under 20 (corresponding to a base miscalling rate of >1%) are changed to 'N,' and only reads with at least half the called bases above Q20 are retained for subsequent analysis. Reads are aligned to pC2c5, and the sharp boundaries of the coverage indicate processing sites for the gRNA, which is presumed to be catalyzed by a ribonuclease domain within C2c5, based on homology with other effectors from Type V CRISPR-Cas systems such as Cpf1, Cas12c, and Cas12d.

Defining Specificity for the PAM and Target Site

In order to determine the flexibility in PAM recognition by C2c5, the gRNA for each of the different C2c5 homologs is varied, so that target sites with variable PAMs are all tested. In one embodiment, the PAMs are varied simply by tiling gRNAs in 1-bp increments along a locus of interest; in another embodiment, the gRNA is changed so that different loci are queried while the PAM is also altered. Using the qPCR approach described above, the RNA-guided DNA integration efficiency for each target site can be quantified, and comparison of the data allows robust definition of high-activity PAM sequences, as well as future avoidance of PAM sequences that show little or no activity for targeting.

In order to test the specificity of DNA targeting by RNA-guided C2c5, and the resulting impacts on DNA integration activity by the Tn7 transposase, mismatches are systematically introduced into gRNAs that target a fixed sequence in the *E. coli* genome. Specifically, mismatches are introduced in 1-, 2-, 3-, or 4-nt increments along the entire 37-nt length of the spacer sequence, and then the transposition experiments are performed described above. By using qPCR to quantify the resulting RNA-guided DNA integration efficiencies across the panel of gRNAs tested, the sequence specificity of DNA targeting afforded by C2c5 is determined, and any discrimination (or lack of discrimination) for mismatches in the RNA-DNA heteroduplex as a function of position along the length of the gRNA/target is identified. By performing the experiment across multiple distinct target sites, general rules for target site selection can be derived.

In further embodiments of these experiments, libraries of gRNAs are used to more exhaustively define sequence requirements upon PAM recognition and target recognition during RNA-guided DNA integration. Specifically, in a pooled library format, in which the CRISPR array is cloned within the Tn7-like transposon cargo itself, transposition is performed across a large pool of cells (e.g. $10^6$-$10^8$ cells), and then transposition products are deep sequenced. By using paired-end sequencing, the integration site, as well as the particular gRNA variant that enabled integration can be determined, since the spacer sequence itself is embedded within the amplicon being sequenced. Mutagenized libraries of gRNAs are designed so that every possible single, double, triple, and quadruple mismatch is probed within a single pooled library experiment, and the resulting data analysis allow extrapolation of a richer set of rules defining target site selection during DNA binding by C2c5.

Defining RNA-Guided DNA Integration Specificity Genome-Wide

In order to probe genome-wide transposition, transposon-insertion sequencing is performed. Specifically, transposition experiments are performed as described above, except pDonor contains point mutations in the transposon ends that introduced MmeI restriction site. Colonies from triple antibiotic LB-agar plates containing IPTG (typically numbering in the range of $10^2$-$10^3$) are resuspended in 4 mL fresh LB medium, and 0.5 mL (corresponding to ~$2\times10^9$ cells) is used for genomic DNA (gDNA) extraction with the Wizard Genomic DNA Purification Kit (Promega). This procedure typically yields 50 µL of 0.5-1.5 µg/L gDNA, which is a mixture of the *E. coli* circular chromosome, pDonor, pTnsBCQ, and pC2c5.

NGS libraries are prepared in parallel on 96-well plates, as follows. First, 1 µg of gDNA is digested with 4 Units of MmeI (NEB) for 12 hours at 37° C. in a 50 µL reaction containing 50 µM S-adenosyl methionine and 1× CutSmart Buffer, prior to heat inactivation at 65° C. for 20 minutes. MmeI cleaves the transposon directly outside of the terminal repeat, leaving 2-nt 3'-overhangs. Reactions are cleaned up using 1.8×Mag-Bind TotalPure NGS magnetic beads (Omega) according to the manufacturer's instructions, and elutions are performed using 30 µL of 10 mM Tris-Cl, pH 7.0. MmeI-digested gDNA is ligated to a double-stranded i5 universal adapter containing a terminal 5'-NN-3' overhang in a 20 µL ligation reaction containing 16.86 µL of MmeI-digested gDNA, 280 nM adapter, 400 Units of T4 DNA ligase (NEB), and 1×T4 DNA Ligase Buffer. Reactions are incubated at room temperature for 30 minutes, before being cleaned up with magnetic beads as before. To reduce the degree of pDonor contamination within the NGS libraries, since pDonor also contains the full-length transposon with an MmeI site, the presence of a unique HindIII restriction site just outside the transposon right end within pDonor is utilized. The entirety of the adapter-ligated gDNA sample is thus digested with 20 Units of HindIII (NEB) in a 34.4 µL reaction for one hour at 37° C., before a heat inactivation step at 65° C. for 20 minutes. Magnetic bead-based DNA clean-up is performed as before.

Adapter-ligated transposons are enriched in a PCR-1 step using a universal i5 adapter primer and a transposon-specific primer containing a universal i7 adapter as 5' overhang. Reactions are 25 µL in volume and contained 16.75 µL of HindIII-digested gDNA, 200 µM dNTPs, 0.5 µM primers, 1×Q5 Reaction Buffer, and 0.5 Units Q5 Hot Start High-Fidelity DNA Polymerase (NEB). Amplification is allowed to proceed for 25 cycles, with an annealing temperature of 66° C. Reaction products are then diluted 20-fold into a second 20 µL polymerase chain reaction (PCR-2) containing indexed p5/p7 primers, and this is subjected to 10 additional thermal cycles using an annealing temperature of 65° C. After verifying amplification for select libraries by analytical gel electrophoresis, barcoded reactions are pooled and resolved by 2% agarose gel electrophoresis, DNA is isolated by Gel Extraction Kit (Qiagen), and NGS libraries are quantified by qPCR using the NEBNext Library Quant Kit (NEB). Illumina sequencing is performed using a NextSeq mid output kit with 150-cycle single-end reads and automated demultiplexing and adapter trimming (Illumina). Individual bases with Phred quality scores under 20 (corresponding to a base miscalling rate of >1%) are changed to 'N,' and only reads with at least half the called bases above Q20 are retained for subsequent analysis.

Analysis of Tn-seq data is performed, as follows. The software application Geneious Prime is used to further filter reads based on three criteria: that read lengths correspond to the expected products resulting from MmeI cleavage of and adapter ligation to genomically integrated transposons; that each read contain the expected transposon end sequence (allowing for one mismatch); and that the transposon-flanking sequence map perfectly to the reference genome. Mapping to the E. coli BL21(DE3) genome (GenBank accession CP001509) is done using the function 'Map to reference' and the following settings. Mapper: Geneious; Fine tuning: None (fast/read mapping); Word length: 17; Maximum mismatches: 0%; Maximum Ambiguity: 1. The 'Map multiple best matches' setting is set to either 'none,' effectively excluding any reads except those that map uniquely to a single site (referred to as 'uniquely mapping reads'), or to 'all,' which allows reads to map to one or multiple sites on the E. coli genome (referred to as 'processed mapping reads'). Both sets of reads are exported as fastq files and used for downstream analysis using custom Python scripts.

To visualize the genome-wide integration site distribution for a given sample, 'uniquely mapping reads' are mapped to the same E. coli reference genome with custom Python scripts. The integration site is defined for each read as the genomic coordinate (with respect to the reference genome) corresponding to the 3' edge of the mapped read. For visualization purposes, integration events within 5-kb bins are computed and plotted as genome-wide histograms using the Matplotlib graphical library.

Plots comparing integration sites among biological replicates are generated by binning the genome wide histograms into 100-bp bins. The bins were shifted so that the 3' end of the C2c5 target site for each sample corresponds to the start of its corresponding 100-bp bin.

To analyze the primary integration site for each sample, custom Python scripts are used to map 'processed mapping reads' to a 600-bp genomic window surrounding the corresponding genomic target site. For reads mapping to the opposite strand as the target (i.e. for the T-LR orientation, in which integration places the 'left' transposon end closest to the C2c5 binding site), the integration site is shifted from the 3' edge of the target site in order to account for the target-site duplication. The primary integration site within this 600-bp window is defined by the largest number of mapped reads, while 100 bp centered at the primary integration site is defined as the 'on-target' window. The percentage of on-target integration for each sample is calculated as the number of reads resulting from transposition within the 100-bp window, divided by the total number of reads mapping to the genome. The ratio of integration in one orientation versus the other is determined; this parameter utilizes on-target reads, and is calculated as the number of reads resulting from integration of the transposon 'right' end closest to the C2c5 binding site (T-RL), divided by the number reads resulting from integration of the transposon left end closest to the C2c5 target site (T-LR). The distribution of integration around the primary site is plotted for both orientations for each sample.

Additional Areas of Investigation

Unlike Tn7 transposon that encode Type I-F CRISPR-Cas systems, such as the V. cholerae system, the Tn7-like transposons that encode Type V-U5 CRISPR-Cas systems (C2c5) appear to lack the tnsA gene. The TnsA protein in well-studied Tn7 transposons directs cleavage of the 5' end of the Tn7 transposon during excision, thus leaving open the possibility that Tn7-like transposons whose mobilization is guided by C2c5 may transposase through a different mechanism other than the cut-and-paste mechanism employed by E. coli Tn7 and V. cholerae RNA-guided Tn7, specifically, through replicative transposition. By designing PCR experiments to monitor the entire cargo that ends up genomically integrated, cut-and-paste versus copy-and-paste mobilization pathways can be distinguished.

Additionally, C2c5-containing Tn7-like transposons are often present next to tRNA genes in the genomes in which they reside. The above experiments indicate if these transposons retain a mechanism to transpose directly adjacent to tRNA genes.

Example 5

Targeted DNA Enrichment Via Programmable RNA-Guided DNA Integration

Despite the reduced cost of next-generation DNA sequencing (NGS), it remains impractical to subject large numbers of genomes, and eukaryotic genomes in particular (e.g. clinical human samples), to whole genome sequencing. Thus, it is often necessary to enrich select genomic regions of interest for targeted enrichment and sequencing, to save time, money, and data storage needs, while increasing sample throughput. As a result, considerable efforts have focused over recent years on target enrichment methods, whereby regions of interest are 'captured' from a purified DNA sample, before being subjected to NGS. Current target enrichment strategies can generally be group into three categories: PCR-based target enrichment, in which the choice of PCR primers allows user-defined loci to be specified; molecular inversion probes (MIPs), based on target circularization; and direct selection based on hybridization capture.

In PCR-based target enrichment, multiplex PCR may be performed to simultaneously amplify many regions in a single reaction vessel, however this often leads to high levels of nonspecific amplification, and many amplicons fail to amplify efficiently. Another major disadvantage of PCR-based methods is that amplification efficiency differs widely across distinct amplicons, and so individual PCRs must be validated prior to pooling and barcoding, so that even coverage of the PCR products of interest is achieved in downstream NGS applications. Microdroplet technology may be used, similar to emulsion PCR and other strategies may be used to improve the fidelity of PCR-based target enrichment, e.g., rhAmpSeq (Integrated DNA Technologies; Dobosy et al., BMC Biotechnol. 11, 80 (2011)).

Molecular inversion probes suffer from poor capture uniformity, and the fact that MIP oligonucleotides can be costly and difficult to obtain in large numbers.

Direct selection based on hybridization capture relies on synthetic oligonucleotides to capture desired molecules from a shotgun input library based on nucleic acid hybridization, and may be performed either on a solid support (array capture), or in solution (solution hybridization). In array capture, a DNA microarray is designed to contain short probes against the genomic regions of interest, the input sample is added to the array in a hybridization step, and after a series of washes, the captured DNA molecules are eluted and prepared for downstream NGS. In-solution capture relies on bead-based pull-down of hybrid molecules of interest, followed by elution and preparation for downstream NGS. These methods have important disadvantages, including requiring expensive hardware (in the case of on-array capture); a strong bias of fragment length on capture efficiency; severe biases against low or high G+C content DNA; poor recovery for clinical specimens that may have lower sample integrity; anomalous recovery due to issues with poor annealing and/or secondary structure, since the input DNA and probes must be denatured and used as single-stranded DNAs.

Figure 32A:
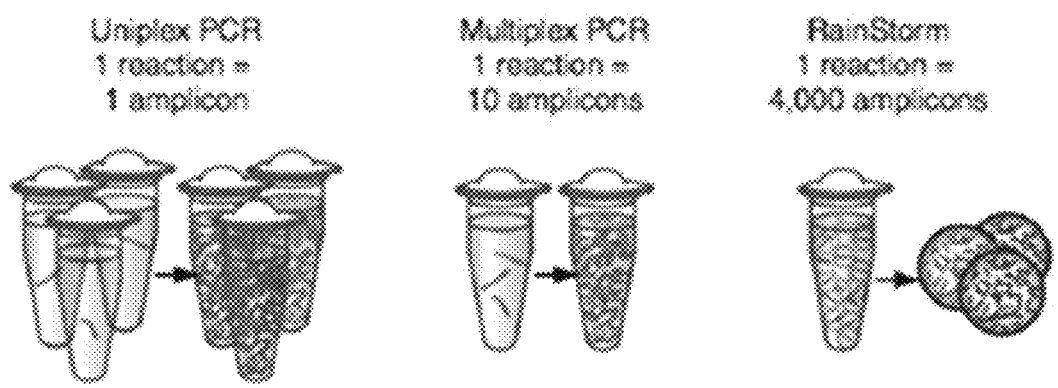
FIGS. 32A-32C are representative pre-existing approaches for targeted DNA enrichment.
Figure 32B:
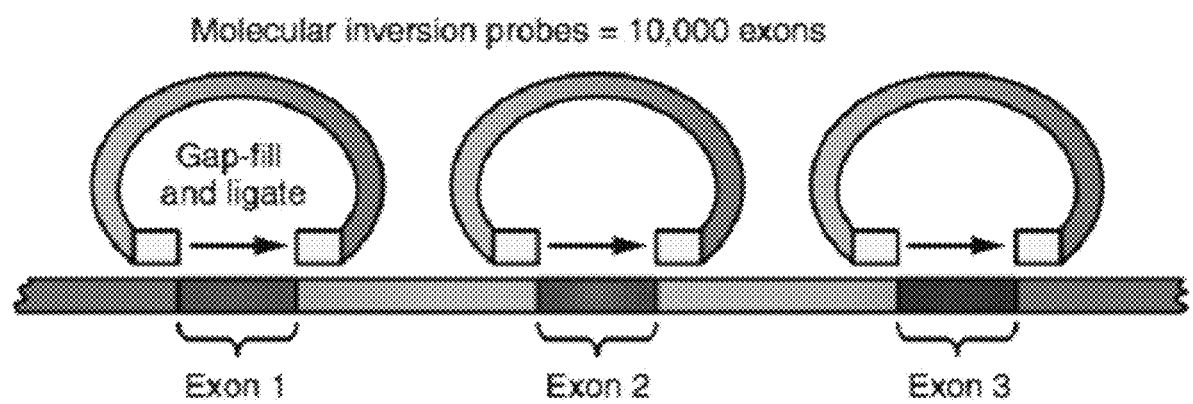
Figure 32C:
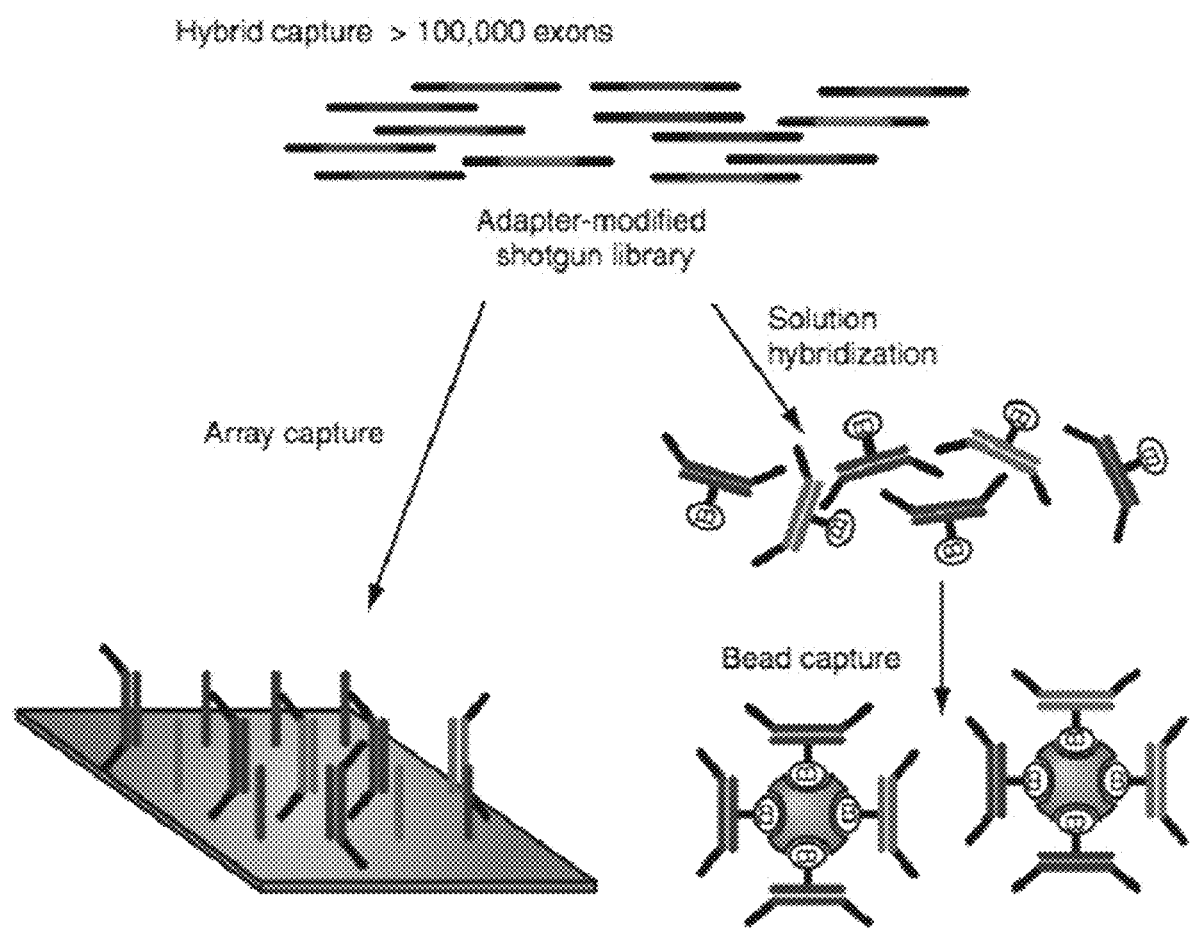
Figure 33C:
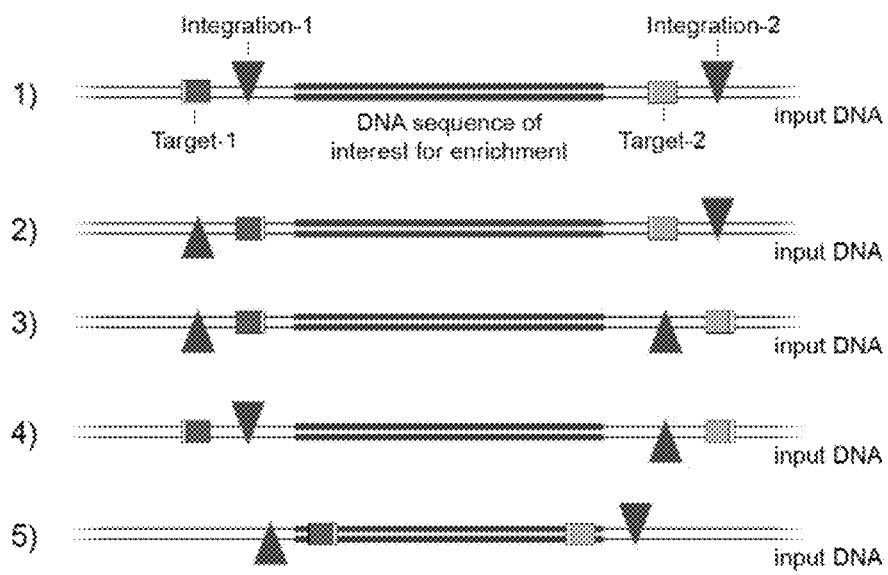
Figure 33D:
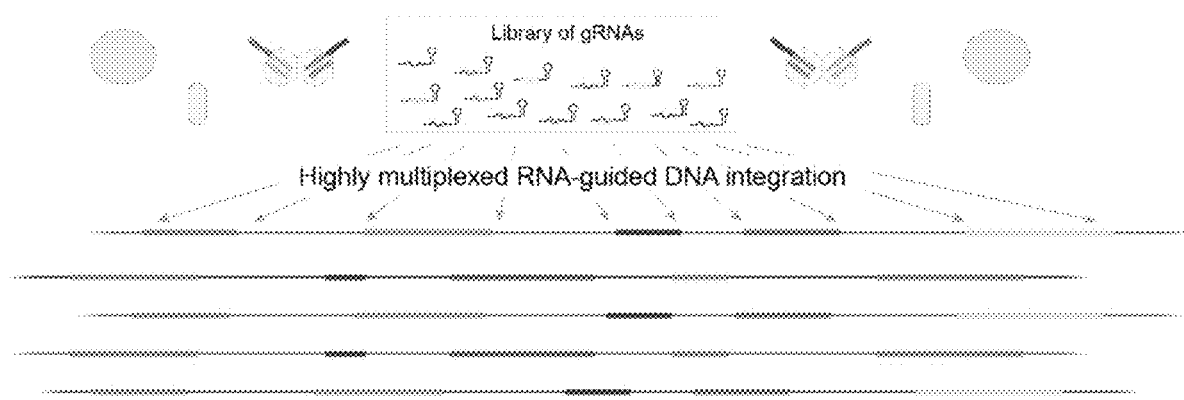

For a review of target enrichment strategies, see FIGS. 32A-32C and Mamanova et al., *Nat Meth* 7, 111-118 (2010).

More recently, researchers have also explored the use of CRISPR-Cas9 and dCas9-based approaches for target enrichment (see for example: Slesarev et al., *Sci Rep* 9, 3587 (2019); Lee et al., Nucleic Acids Res. 47, e1 (2019); and references therein). However, these methods perform poorly with respect to actual DNA enrichment (i.e. very low on-target ratios, and large recovery of off-target DNAs), and the NGS data produced from libraries generated with these methods had low sequencing quality.

Targeted DNA enrichment is presently used in a number of clinically important workflows, including, but not limited to: whole exome sequencing (WES; see Suwinski et al., Front. Genet. 10, 49 (2019); Warr et al., G3 (Bethesda) 5, 1543-1550 (2015)); deep sequencing of patient adaptive immune repertoires, specifically, T-cell receptor and immunoglobulin diversification (see Friedensohn et al., Trends Biotechnol 35, 203-214 (2017); Rosati et al., BMC Biotechnol. 17, 61 (2017)); and targeted enrichment and deep sequencing of cancer biomarkers in the context of oncology (Kamps et al., Int J Mol Sci 18, (2017)).

The CRISPR-Tn7 system for biochemical RNA-guided DNA integration in vitro (i.e. with purified protein/RNA components and input DNA), may be used as a method for targeted DNA enrichment. All of the sufficient or necessary molecular components of the CRISPR-Tn7 system are expressed recombinantly and purified, which in the case of the CRISPR-Tn7 system from *Vibrio cholerae*, includes, for example, Vch TnsA, TnsB, TnsC, TniQ, Cas8, Cas7, Cas6, and gRNA. Cas8 is a natural fusion of Cas8 and Cas5 polypeptides, hereafter in this Example referred to simply as Cas8. The gRNA may comprise a single gRNA, but in most embodiments, comprises a library of gRNAs that are designed to target complementary DNA sequences of interest (e.g. the 32-bp protospacer, flanked by a protospacer adjacent motif, or PAM), such that RNA-guided DNA integration occurs proximal to a DNA sequence of interest for downstream enrichment.

The protein and gRNA components are combined with engineered transposon Left ("L") and Right ("R") end sequences, which may be present as a single linear double-stranded DNA (dsDNA) flanking an internal genetic payload, or as two separate DNA molecules, each one of which comprises a dsDNA L or R end; the transposon ends may also be covalently attached to a genetic payload. The genetic payload may be a short adaptor, such as a sequence used for downstream primer binding during a PCR amplification step, as would be performed for NGS library preps for massively parallel DNA sequencing, such as with the Illumina platform. The transposon end sequences themselves may also serve as the primer binding sites for downstream NGS library preparation. The protein and RNA molecular components, together with the transposon end sequences which are sometimes linked to a user-defined genetic payload, or adaptor, are then combined with input DNA containing the sequence(s) of interest to be enriched. The DNA may be purified genomic DNA, genomic DNA within a cellular lysate or other cellular extracts, mixtures of DNA from metagenomic samples, DNA from viruses, DNA from bacterial, archaeal, and/or eukaryotic cells, or other types of DNA samples.

In one embodiment, the input DNA is subjected to highly multiplexed, in vitro RNA-guided DNA integration (FIGS. 33A-33D), whereby the transposon ends, with or without distinct adaptor sequences, become covalently fused at 1-10, 10-100, 100-1,000, 1,000-10,000, or 10,000-100,000 distinct integration sites, specified by the particular library of gRNAs used.

In this embodiment, the RNA-guided DNA integration serves two purposes: the input DNA (e.g. purified genomic DNA), becomes fragmented by the enzymatic activity of TnsB during the integration reaction, and the transposon end sequences (and when present, adaptor sequences) are covalently linked to the DNA molecules of interest. These transposon end sequences, or when present, the adaptor sequences, are then amplified by PCR in a subsequent amplification step using primer pairs that specifically bind to these universal sequences, obviating any requirement for multiplexed PCR or oligo and hybridization-based capture approaches. RNA-guided DNA integration effectively serves to specify the DNA sequences to be enriched and integrate convenient and universal primer binding sites proximally, for standard NGS library preparation steps.

Figure 34A:
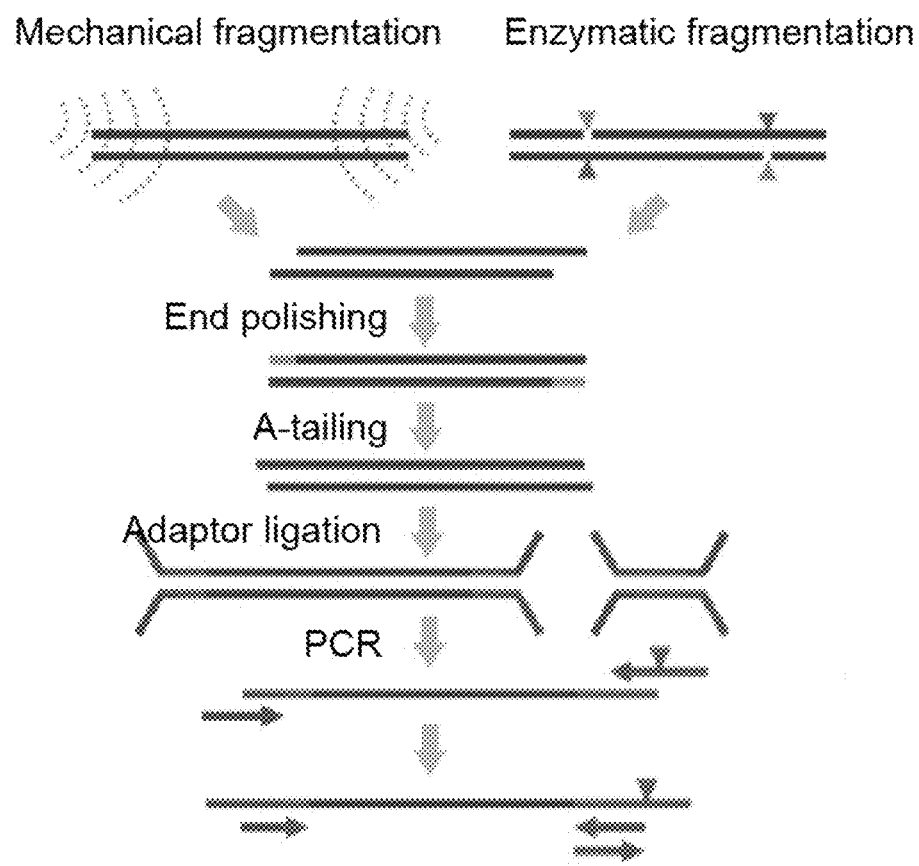
FIGS. 34A-34B are schematics of pre-existing methods of generating random fragment libraries from input DNA.
Figure 34B:
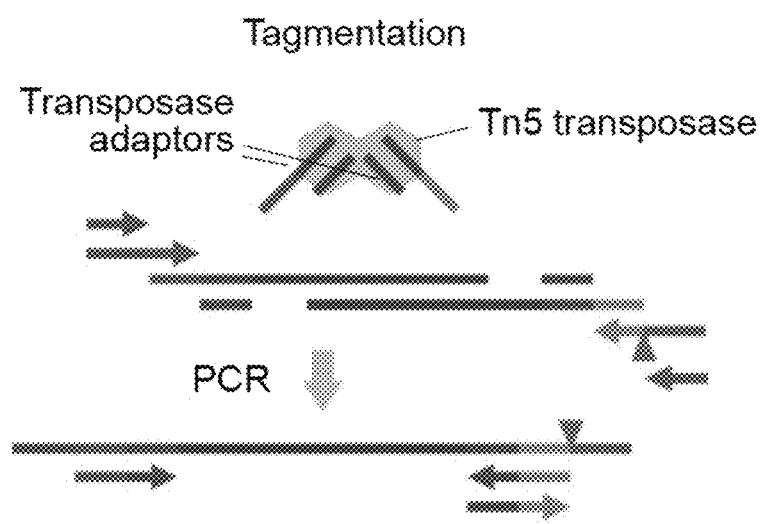

Conceptually, the use of CRISPR-Tn7 for target enrichment, as an alternative to other methods such as multiplex PCR and/or hybrid capture, offers similar advantages for streamlined NGS library preparation, as are enabled by tagmentation-based methods of NGS library preparation, e.g. the use of engineered Tn5 transposases for DNA fragmentation and adaptor insertion in the 'Nextera' kit (FIGS. 34A and 34B). However, the Tn5 transposase intrinsically has little to no target specificity, though there are noted insertion biases (Reznikoff, Annu Rev Genet 42, 69-286 (2008); Adey et al., *Genome Biol* 11, R119 (2010)). Conversely, the CRISPR-Tn7 system is fully programmable, in that DNA targeting is dictated exclusively by the sequence of the gRNA, and the integration of the transposon (or engineered mini-transposon) occurs at the integration site a fixed distance downstream of the gRNA-complementary target site. Thus, unlike Tn5 and Nextera, which can only be leveraged for random insertion of a genetic tag or adaptor of interest, CRISPR-Tn7 is leveraged for the precise and highly accurate insertion of a genetic tag or adaptor of interest, at user-defined genomic sites. This enables gRNAs to be designed for selective insertion of the adaptor at regions flanking all the DNA sequences to be enriched, such that subsequent PCR allows for a uniform and universal primer set to amplify all the DNA sequences in a single step, but without the complexities of multiplexed primer pairs, MIPs, or hybrid capture methods.

Advantages of this method include, but are not limited to:
  a significant decrease in labor; RNA-guided DNA integration obviates the need for labor-intensive mechanical and enzymatic manipulations, such as DNA fragmentation, end repair, ligation, DNA microarray synthesis, capture or MIP probe synthesis, etc.;

a decrease in time; many steps are replaced with a single biochemical RNA-guided DNA integration reaction, which is performed in 5-10, 10-30, 30-60, or 60-120, or 120-240 minutes;

low input requirements; because of the reduced steps and reduced number of molecular biology steps, this method allows for smaller input DNA samples to be adapted for downstream NGS library preparation; and lower sequence biases and better uniformity in targeted enrichment.

Because this method introduces universal adaptor sequences, the PCR amplification steps to generate NGS libraries do not suffer from anomalous and variable amplification efficiencies, probe or input DNA secondary structure issues, G+C bias in amplification, primer binding site variation, etc. Rather than the numerous steps typically required, including, to fragment the DNA; to add common adaptor sequences that are needed for clonal amplification and/or priming sequencing reactions; and to enrich the target sequences of interest via one of the methods described above, the described method performs these steps in a single reaction with purified CRISPR-Tn7 components and gRNAs designed against the targeted DNA sequences of interest. A single PCR step may then be used to amplify and thereby selectively enrich the targeted sequences that underwent adaptor integration. In another embodiment, the integrated DNA may be used directly for massively parallel DNA sequencing, without a requirement for PCR amplification.

This method may be applied to various application areas, such as for clinically important workflows. These include, but are not limited to: whole exome sequencing (WES; see Suwinski et al., *Front. Genet.* 10, 49 (2019) and Warr et al., *G3* (Bethesda) 5, 1543-1550 (2015), incorporated herein by reference); deep sequencing of patient adaptive immune repertoires, specifically, T-cell receptor and immunoglobulin diversification (see Friedensohn et al., *Trends Biotechnol* 35, 203-214 (2017) and Rosati et al., *BMC Biotechnol.* 17, 61 (2017), incorporated herein by reference); and targeted enrichment and deep sequencing of cancer biomarkers in the context of oncology (Kamps et al., *Int J Mol Sci* 18, (2017), incorporated herein by reference).

Purification of CRISPR-Tn7 Components

In one embodiment, all *V. cholerae* protein components (TnsA, TnsB, TnsC, TniQ, Cas6, Cas7, and Cas8) are recombinantly expressed and purified individually, and RNA-guided DNA integration is later reconstituted by mixing the proteins in vitro together with gRNA.

Figure 35A:
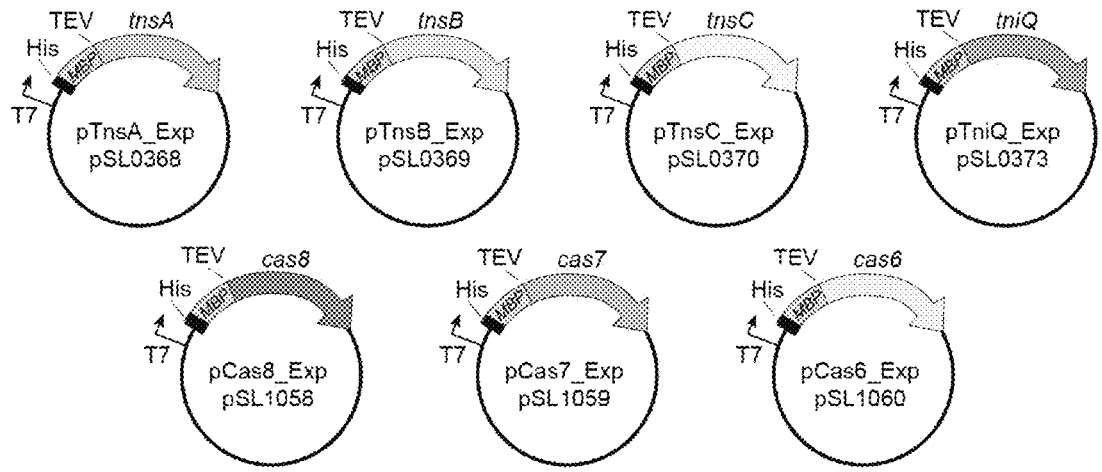
FIGS. 35A-35E are schematics of the preparation of recombinant CRISPR-Tn7 components for in vitro RNA-guided DNA integration.
Figure 35B:
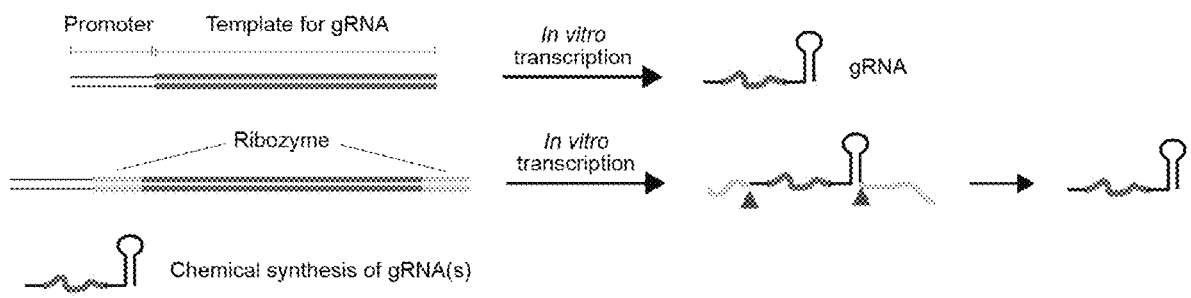

Expression plasmids were generated to encode each of the individual proteins from *Vibrio cholerae* with an N-terminal decahistidine tag and maltose binding protein (MBP) solubilization tag, driven by a T7 promoter (FIG. 35A). The plasmid also codes for a TEV protease recognition site downstream of the MBP solubilization tag, allowing for removal of the N-terminal tag during purification. In other embodiments, the histidine tag may be moved to the C-terminus or replaced with an alternative affinity tag; the MBP tag may be moved to the C-terminus, replaced with an alternative solubilization tag, or removed from the expression construct altogether; the T7 promoter may be replaced with an alternative promoter; and other design criteria of the expression vectors may be altered. The gRNA may be produced by run-off in vitro transcription, from a DNA template encoding the mature gRNA; it may be produced by run-off in vitro transcription from a DNA template that also contains ribozymes at the 5' and/or 3' end, followed by ribozyme cleavage to liberate the mature gRNA; or it may be synthesized chemically as a mature 60-nucleotide gRNA (FIG. 35B). Often, a pooled library of gRNAs is generated, either through the chemical synthesis of the pool directly, or via in vitro transcription, starting with a pool of DNA templates that encode the mature gRNA or a precursor thereof. The pool of DNA templates may be generated by DNA oligo array synthesis. The gRNA may also be produced as a precursor CRISPR RNA, and then processed enzymatically by purified Cas6, which is naturally a ribonuclease that processes the precursor CRISPR RNA into the mature CRISPR RNA (i.e. the gRNA).

Figure 35C:
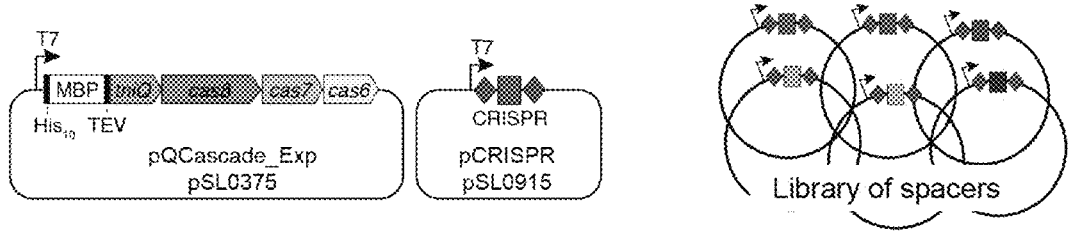

In another embodiment, the TniQ-Cascade complex, harboring either a user-defined gRNA, or a pooled library of user-defined gRNAs, is recombinantly expressed and purified as a co-complex. The TniQ-Cascade complex comprises TniQ, Cas6, Cas7, and Cas8, in a 2:1:6:1 stoichiometry, and is expressed in *E. coli* from a plasmid denoted pQCascade together with pCRISPR (FIG. 35C); the CRISPR array may also be encoded directly on the same protein-coding pQCascade plasmid. The plasmid may code for a single mature gRNA, or may contain a library of spacers coding for a corresponding library of gRNAs, such that the recombinantly purified TniQ-Cascade complex represents a pool of RNA-guided DNA targeting complexes containing gRNAs against all the target DNA sequences of interest for targeted DNA enrichment.

Figure 35D:
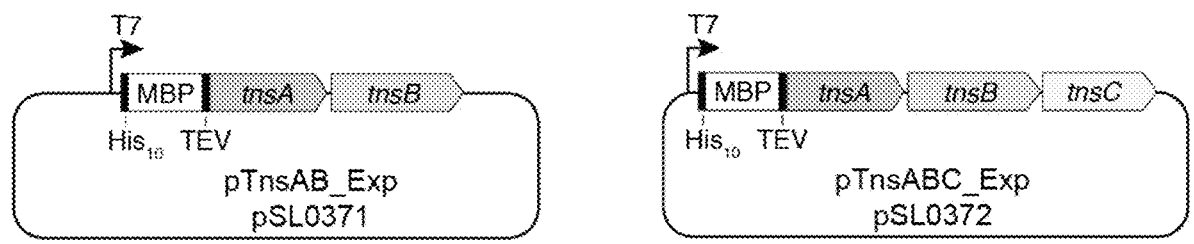
Figure 35E:
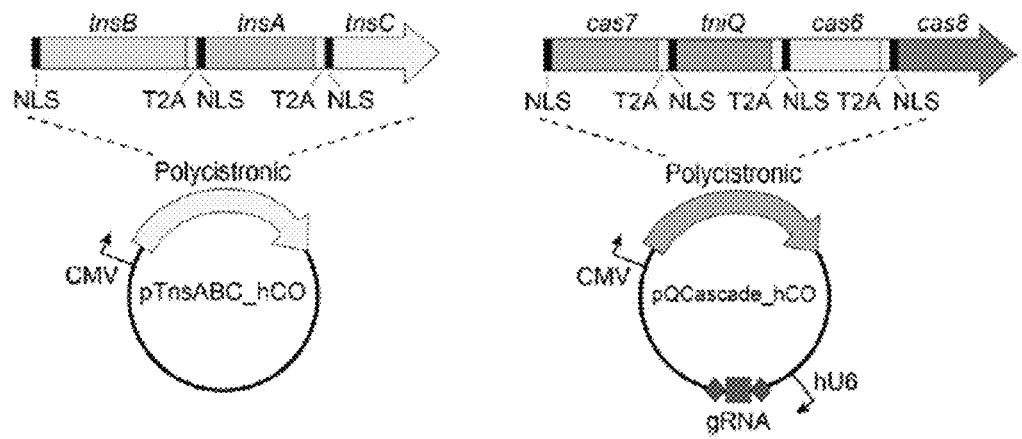

TnsA and TnsB from *E. coli* are known to form direct heterodimeric interactions (Choi et al., *Proc Natl Acad Sci USA* 110, E2038-45 (2013)), and TnsA and TnsC from *E. coli* also form a specific interaction (Ronning et al., *EMBO J* 23, 2972-2981 (2004); Peters, *Microbiol Spectr* 2, (2014)). In one embodiment, *V. cholerae* TnsA and TnsB are cloned into an *E. coli* expression vector as a single operon, with an affinity and solubilization tag present on only the TnsA subunit, and the TnsA-TnsB complex is co-purified (FIG. 35D). In another embodiment, the entire TnsA-TnsB-TnsC operon is cloned into an *E. coli* expression vector with a single affinity and solubilization tag present on TnsA, and the TnsA-TnsB-TnsC complex is co-purified (FIG. 35D). In further embodiments, the order of genes may be switched, and the choice and location of affinity and/or solubilization tags may be altered.

Proteins are purified according to the following general protocol, though differences are introduced based on protein-specific requirements for various embodiments. *E. coli* BL21(DE3) cells harboring one or more plasmids were grown at 37° C. to $OD_{600}$=0.5-0.7, at which point IPTG is added to a final concentration of 0.5 mM and growth is allowed to continue at 16° C. for an additional 12-16 hours. Cells are harvested by centrifugation at 4,000×g for 20 minutes at 4° C. Cell pellets are resuspended in Lysis Buffer (50 mM Tris-Cl, pH 7.5, 100 mM NaCl, 0.5 mM PMSF, EDTA-free Protease Inhibitor Cocktail tablets (Roche), 1 mM DTT, 5% glycerol) and lysed by sonication with a sonic dismembrator (Fisher) set to 40% amplitude and 12 minutes total process time (cycles of 10 seconds on and 20 seconds off, for a total of 4 minutes on and 8 minutes off). Lysates are clarified by centrifugation at 15,000×g for 30 minutes at 4° C. Initial purification is performed by immobilized metal-ion affinity chromatography with Ni-NTA Agarose (Qiagen) using NiNTA Wash Buffer (50 mM Tris-Cl, pH 7.5, 100 mM NaCl, 10 mM imidazole, 1 mM DTT, 5% glycerol) and NiNTA Elution Buffer (50 mM Tris-Cl pH 7.5, 100 mM NaCl, 300 mM imidazole, 1 mM DTT, 5% glycerol). The $His_{10}$-MBP fusion is removed by incubation with TEV protease overnight at 4° C. in NiNTA Elution Buffer, and proteins/complexes are further purified by ion exchange chromatography on an AKTApure system (GE Healthcare)

using a 5 mL HiTrap Q HP Column or HiTrap SP HP Column (GE Healthcare) with a linear gradient from 100% Buffer A (20 mM Tris-Cl, pH 7.5, 100 mM NaCl, 1 mM DTT, 5% glycerol) to 100% Buffer B (20 mM Tris-Cl, pH 7.5, 1 M NaCl, 1 mM DTT, 5% glycerol) over 20 column volumes. Pooled fractions are identified by SDS-PAGE analysis and concentrated, and the sample is further refined by size exclusion chromatography. Fractions are pooled, concentrated, snap frozen in liquid nitrogen, and stored at −80° C. Generally, Lysis Buffer and Ni-NTA Buffers contain 100 mM NaCl when multiprotein complexes are purified, but contain 500 mM NaCl when individual proteins are purified.

Engineering of the CRISPR-Tn7 Left and Right Transposon Ends

In one embodiment utilizing the CRISPR-Cas-containing Tn7-like transposon from *V. cholerae*, the transposon Left and Right ends are engineered to facilitate targeted DNA enrichment (FIGS. 33B and 11A-11C). This engineering may include, among other possible changes: 1) truncation of the transposon ends, beginning distal from the outermost sequences, down to a minimal length that still retains RNA-guided DNA integration activity (this activity may be determined in vivo or in vitro); 2) creation of chimeric transposon ends, in which the Left or Right end sequence is duplicated on both ends; 3) rearrangement of the putative and annotated TnsB binding sites within the Left and/or Right ends; 4) changes in the relative spacing between the putative/annotated TnsB binding sites within the Left and/or Right ends; 5) mutagenesis of the transposon Left and Right ends.

Experiments are performed to determine essential transposon end sequences during RNA-guided DNA integration by the *V. cholerae* CRISPR-Tn7 system. In one approach, each end sequence is subjected to exhaustive random mutagenesis, by cloning modified mini-transposons using synthetic oligonucleotides that have mixed bases at each position, such that the resulting pooled oligos contain all possible single, double, and triple mismatches within the length of the transposon ends (FIGS. 35A-35D). Mini-transposon plasmid libraries are prepared with each transposon end separately mutagenized in this manner, and the plasmid libraries are used in RNA-guided DNA integration experiments in vivo. By performing experiments whereby the internal genetic payload within the mini-transposon contains an antibiotic resistance gene that is only expressed after targeted RNA-guided DNA integration downstream of a promoter within the *E. coli* genome (promoter capture assay), cells are put through antibiotic selection, to enrich for cells that underwent successful RNA-guided DNA integration. The integrated transposon are then analyzed across a population of *E. coli* cells by massively parallel DNA sequencing (next-generation sequencing), for example by transposon-insertion sequencing (Tn-seq), such that the resulting NGS libraries contain information not only about the integration site, but also the sequence of the transposon end that led to successful integration. By sequencing the input transposon plasmid library, and the transposon library that underwent integration, the data are analyzed to determine those transposon end sequences that were depleted-meaning, the mutations were deleterious for function-versus those transposon end sequences that were enriched-meaning, the mutations still allowed for RNA-guided DNA integration. Based on these and related experiments, further engineered transposon are generated that contain minimal sequences that still recapitulate high-efficiency RNA-guided DNA integration.

Figure 11C:
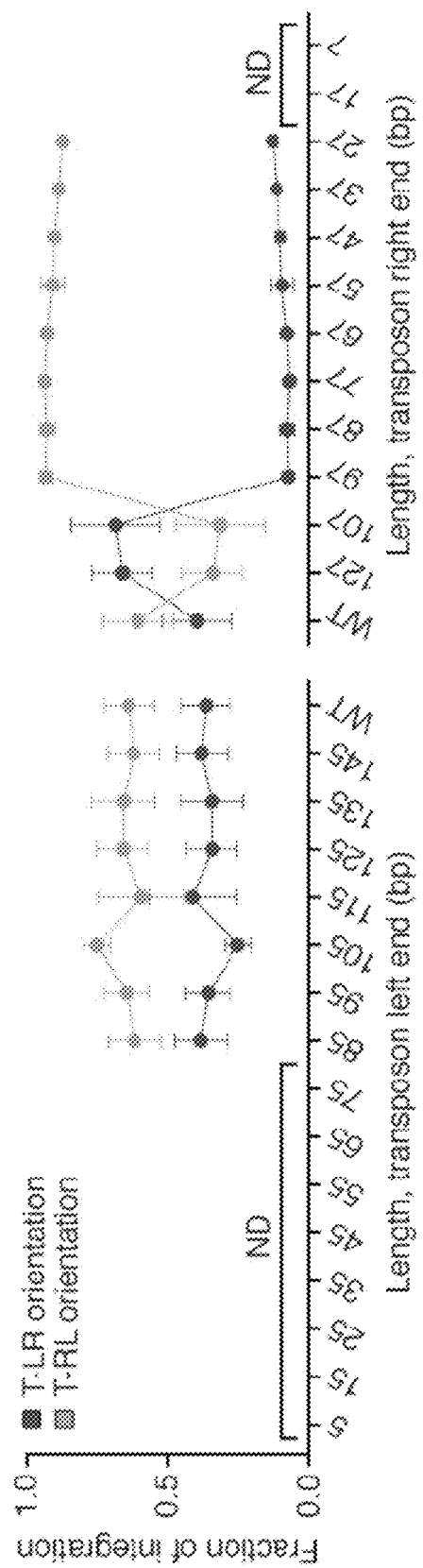
Figure 11D:
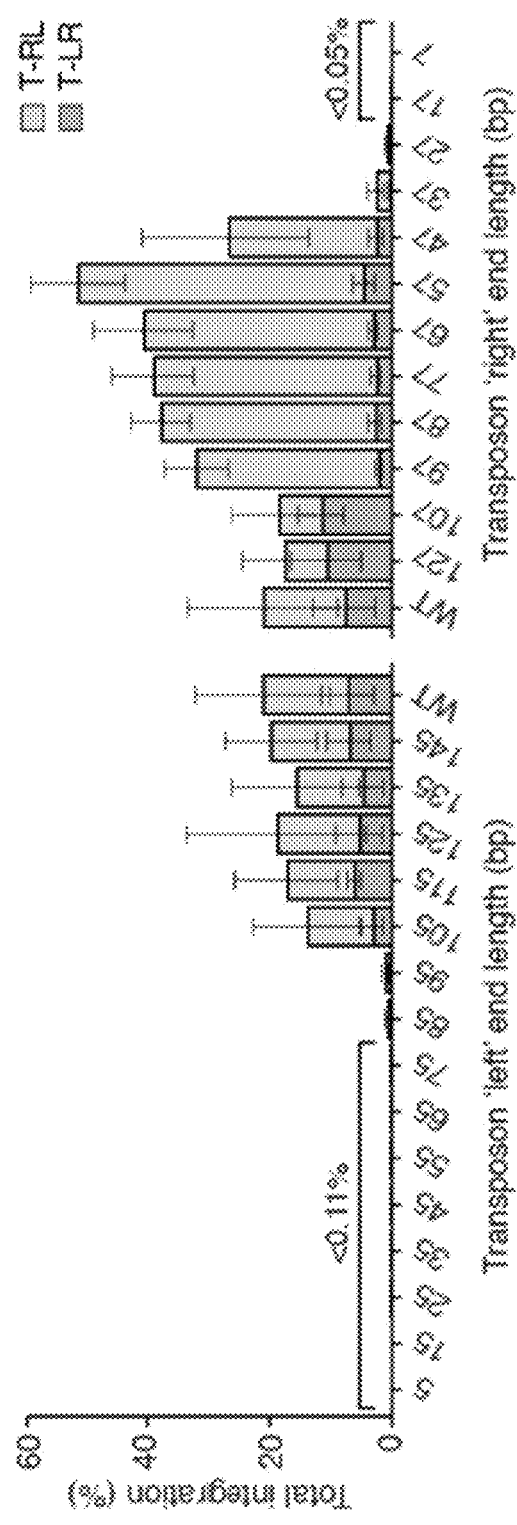

For the in vitro RNA-guided DNA integration experiments described below, in which the input DNA (e.g. purified genomic DNA) is subjected to transposon insertion, the minimally necessary and engineered transposon L and R end sequences, as identified by the previously described experiments, are separated into two dsDNA molecules, each comprising the L and R ends to be used for target enrichment. These dsDNA molecules are bound and integrated by a single CRISPR-Tn7 transpososome complex during RNA-guided DNA integration, but the two ends are not themselves covalently linked, leading to fragmentation of the input DNA at the integration site, and covalent integration of the L and R ends on the upstream and downstream molecules of DNA relative to the integration site (FIGS. 11A-11C). Based on Example 1, which demonstrates that RNA-guided DNA integration with the *V. cholerae* CRISPR-Tn7 system can occur bidirectionally, and data described above with engineered transposon ends, the integration of the separate L and R ends at a targeted integration site may occur in both orientations with similar efficiency, or be biased to one orientation with some frequency, or be completely set in one of two defined orientations.

Figure 36:
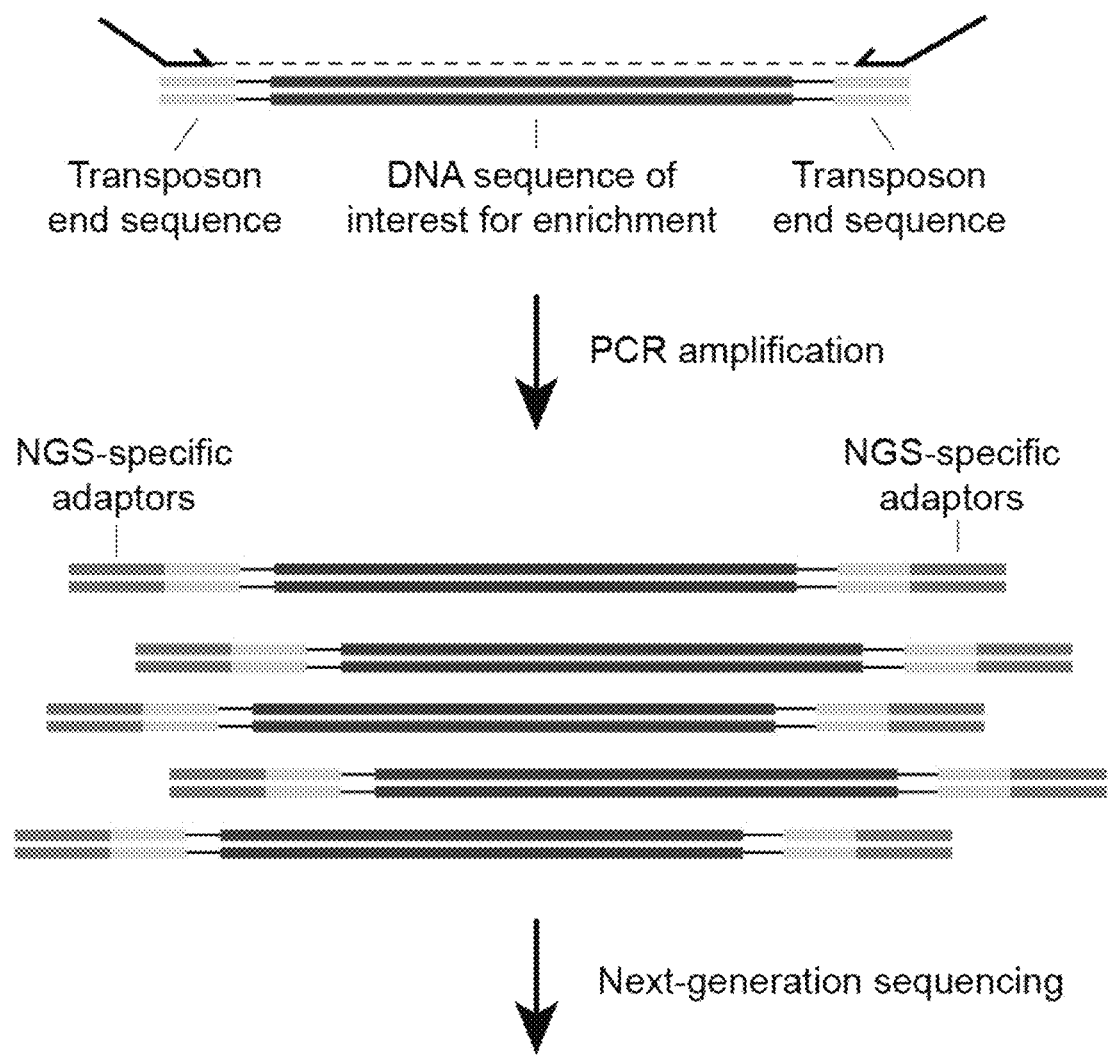
FIG. 36 is the PCR amplification of integrated DNA for next-generation sequencing. In one embodiment, the transposon end sequences (orange lines) serve as primer binding sites for PCR amplification, after targeted RNA-guided DNA integration flanking the DNA sequence of interest (see FIG. 33). PCR primers may also include additional sequences on the overhangs, for indexing and/or appendage of sequences necessary for downstream next-generation sequencing, such as p5/p7 sequences needed for bridge amplification within the Illumina sequencing platform. After PCR and standard clean-up steps, the sample may be used directly for next-generation DNA sequencing.

In one embodiment, the minimal and engineered transposon end sequences themselves serves as the primer binding sites for all subsequent PCR amplification steps within the target enrichment pipeline (FIG. 36). After the input DNA is subjected to multiplexed RNA-guided DNA integration, a universal pair of primers is used to further amplify all the regions targeted for enrichment, by binding to the integrated transposon L and R ends. This universal primer pair may contain additional overhangs tailored to the next-generation DNA sequencing platform of interest; for example, with the Illumina sequencing platform, the p5 and p7 sequences necessary for bridge amplification and cluster generation may be introduced at this stage in the library prep.

In another embodiment, the Tn7 transposon ends are further engineered to contain additional sequencing adaptors just upstream (5') of the minimally required transposon end sequence on both the right and left end. For example, these adaptors may be the same, or be similar to, the read primer sequences used for existing Illumina sequencing with the Truseq or Nextera platforms. These exogenous adaptors could then serve as the primer binding sites for subsequent PCR amplification steps, allowing the target enrichment libraries generated with RNA-guided DNA integration to be used directly with existing Illumina platforms. Primers annealing to the universal Illumina adaptor sequences may contain additional overhangs tailored to the next-generation DNA sequencing platform of interest; for example, with the Illumina sequencing platform, the p5 and p7 sequences necessary for bridge amplification and cluster generation may be introduced at this stage in the library prep. Note that in this embodiment, depending on the particular design of the engineered transposon ends and adaptors, and the choice of read primer, the 'reads' generated during next-generation sequencing with standard Illumina read primers will contain bases derived from the transposon ends, as well as the target DNA sequences of interest.

In a further embodiment, during the PCR amplification step of the integrated input DNA, the universal primer pairs carry unique index sequences upstream of the region complementary to the integrated transposon ends or integrated adaptors, such as the i5 and i7 indices utilized within the Illumina sequencing platform, to enable barcoding of distinct target enrichment libraries across many different samples. This indexing approach enables the same RNA-guided DNA integration to be perform within a 96- or 384-well plate format, in which each well contains a unique input DNA sample but all the same CRISPR-Tn7 protein/gRNA and transposon end components. After transposon end integration, the following PCR amplification uses indexed primer pairs to append a well-specific index or index pair, allowing subsequent library steps, and the downstream sequencing step, to be performed on pooled enrichment libraries across many different input samples.

Figure 37:
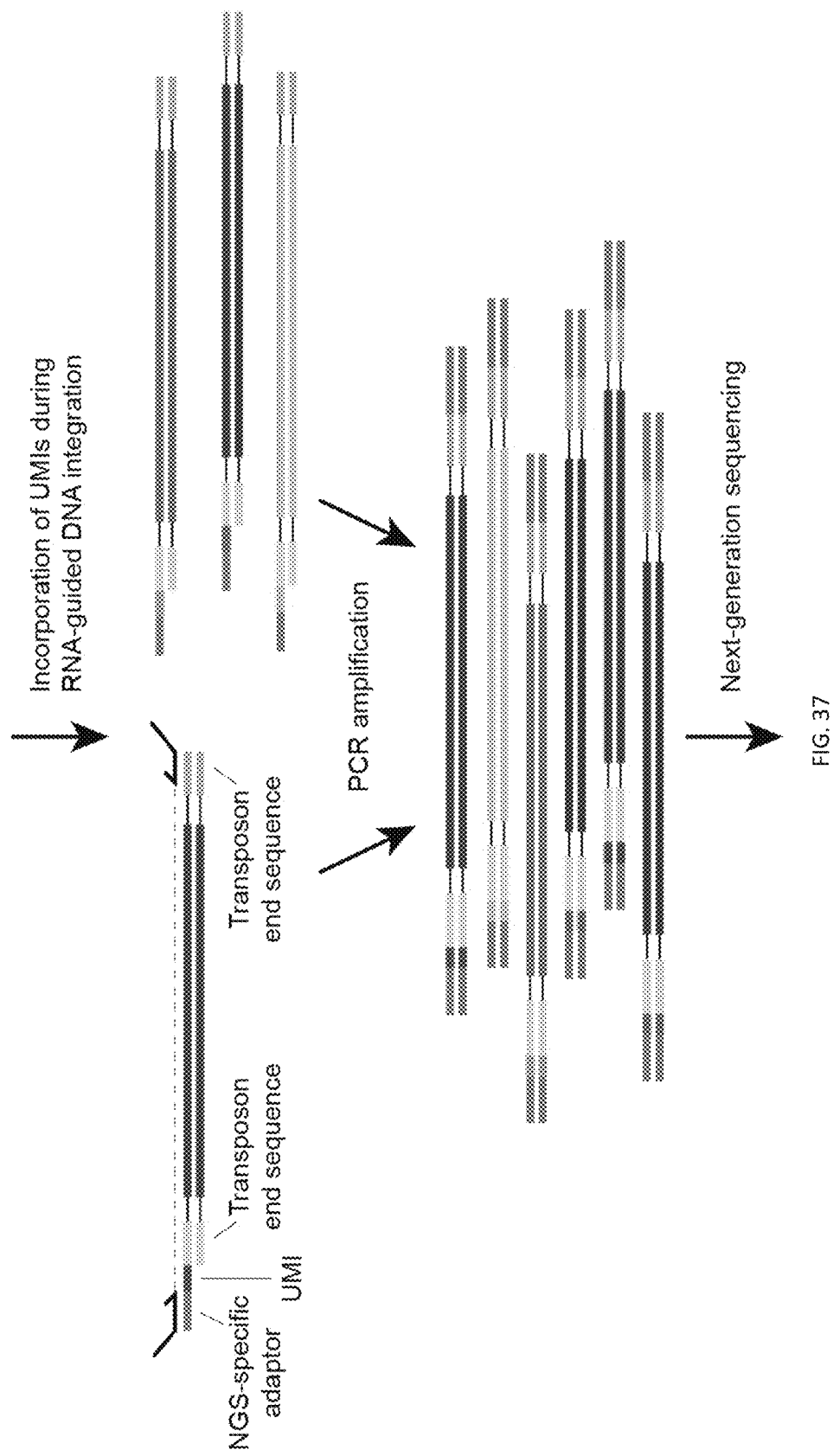
FIG. 37 is the incorporation of unique molecular identifiers (UMIs) during RNA-guided DNA integration. The transposon end sequences used during RNA-guided DNA integration (upstream steps not shown) are designed in such a way, that unique molecular identifiers are incorporated within one of the transposon end donor sequences (denoted UMI in figure, and depicted in various colors). This leads to distinct molecules of the same target sequence of interest (shades of blue) carrying unique tags, which are preserved and amplified in subsequent PCR steps that append adaptors necessary for next-generation DNA sequencing.

In another embodiment, unique molecular identifiers (UMIs, also known as UIDs) are incorporated within the engineered transposon ends, 3' of the sequence used as the primer binding site in subsequent PCR amplification (FIG. 37). The RNA-guided DNA integration reaction is performed the same way as described, followed by PCR amplification using universal primers against the primer binding sites (which may also contain unique indices). The UMIs are preserved within the resulting NGS libraries, allowing for error and bias correction in the resulting data analysis, as well as improved understanding of sequence/allele abundance within the input library.

Reaction Design to Perform In Vitro RNA-Guided DNA Integration

Reactions to perform RNA-guided DNA integration within targeted input DNA contain the following components: purified TnsA, TnsB, TnsC, TniQ, Cas6, Cas7, Cas8, gRNA(s), engineered transposon ends (present as dsDNA), the input DNA (i.e. the 'sample'), and reaction buffer. In one embodiment, the reaction contains purified TniQ-Cascade (comprising TniQ, Cas6, Cas7, Cas8, and gRNA) in place of the individual components. The gRNA may contain 1-10, 10-100, 100-1,000, 1,000-10,000, or 10,000-100,000 unique guide sequences. The engineered transposon ends may contain unique molecular identifiers (UMIs), and may be fully double-stranded or may contain regions that are double-stranded and regions that are single-stranded. The input DNA may be purified genomic DNA, genomic DNA within a cellular lysate or other cellular extract, mixtures of DNA from metagenomic samples, DNA from viruses, DNA from bacterial, archaeal, and/or eukaryotic cells, or other types of DNA samples.

The reaction buffer may contain various cofactors and additives, including, but not limited to: buffering agents (e.g. Tris, HEPES, sodium phosphate) set to varying pH values (e.g. 5.0, 5.5, 6.0, 6.5, 7.0, 7.5, 8.0, 8.5, 9.0); monovalent salts (e.g. NaCl, KCl, potassium glutamate, sodium glutamate); divalent salts (e.g. $MgCl_2$, $CaCl_2$, $MnCl_2$); nucleotides, such as ATP, ADP, ADPNP, ADPCP, and/or ATP-gammaS; crowding agents, such as polyethylene glycol (PEG); detergents (e.g. Triton X-100, Tween-20); cryoprotectants, such as glycerol; reducing agents (e.g. betamercaptoethanol, DTT, T-CEP).

Reactions are incubated for 5-10, 10-30, 30-60, or 60-120, or 120-240 minutes, and are incubated at 5-10° C., 10-15° C., 15-20° C., 20-25° C., 25-30° C., 30-35° C., 35-40° C., 40-45° C., or 45-50° C. Reactions may be quenched with various means, including but not limited to: addition of EDTA; heat inactivation; addition of denaturing agents such as phenol-chloroform or guanidinium hydrochloride; addition of protease agents such as proteinase K; addition of ribonuclease agents. Reactions are cleaned up to remove denatured debris and protein components, before being subjected to subsequent molecular biology steps necessary for next-generation sequencing library preparation, which may include PCR-based amplification.

Method of Generating Short (~50-Bp) Sequencing Libraries Flanked by the Target and Integration Sites During CRISPR-Tn7 RNA-Guided DNA Integration The CRISPR-Tn7 system mobilizes by using gRNAs for recognition of a DNA target site that is complementary to the guide sequence, followed by integration of the transposon donor DNA a fixed distance downstream of the target site, at the integration site; in the *V. cholerae* CRISPR-Tn7 system, DNA targeting is facilitated by the TniQ-Cascade complex, and DNA integration is catalyzed by TnsB ~49-bp downstream (PAM-distal) of the target site.

Figure 38:
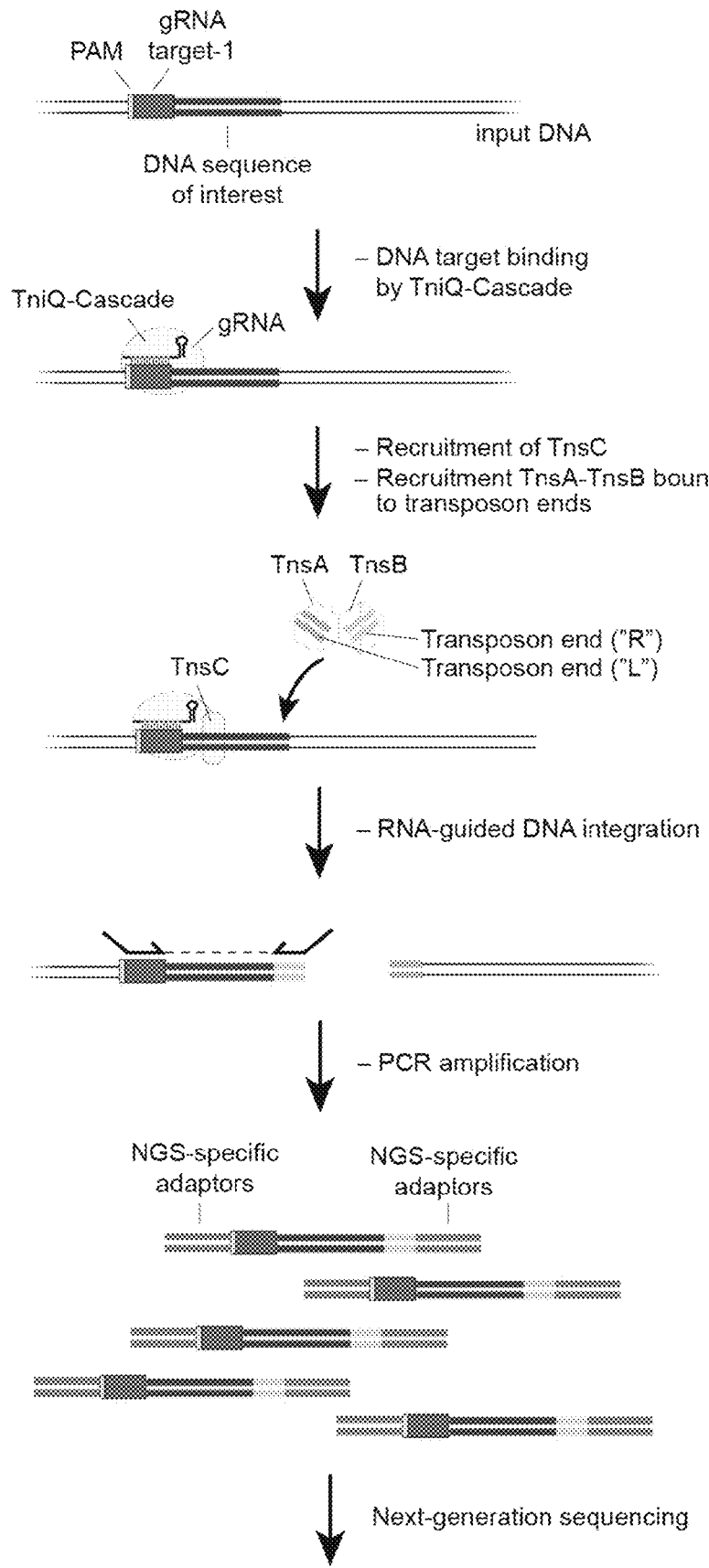
FIG. 38 shows the method for generating sequencing libraries by flanking the sequence of interest with the target and integration site. In this embodiment, the sequence of interest (blue) may be known or unknown, but is flanked on one side with a known sequence (maroon) that serves as the target site for which complementary gRNAs can be designed. RNA-guided DNA integration by the CRISPR-Tn7 system leads to transposon ends (orange/purple, in the embodiment depicted) being integrated ~50-bp downstream of the target site. This arrangement allows the sequence of interest to be selectively amplified in a downstream PCR step, by designing primers that are specific for the target site (maroon) and one of the transposon end sequences (orange). Adaptors for next-generation sequencing (grey) may also be added as overhangs in the PCR step, allowing for downstream next-generation sequencing. The method may be multiplexed across many different sequences of interest.

The relative arrangement of the target site and the integration site suggests a straightforward way for defining and amplifying/enriching DNA libraries that are ~49-bp in size, from a heterogeneous input DNA sample, for downstream analysis by massively parallel next-generation DNA sequencing (NGS) (FIG. 38). The target site in this embodiment is of a known sequence, and for the *V. cholerae* CRISPR-Tn7 system, will be a 32-bp protospacer target site flanked by a 2-nucleotide PAM. The integration site is ~49-bp downstream, and will also comprise a known sequence, since the transposon ends are user-defined and may be engineered, as described above. Thus, upon integration of the transposon ends—which may be part of one continuous dsDNA molecule, or may comprise two individual dsDNA molecules representing the L and R ends—the targeted input DNA will contain short 49-bp sequences abutted by the known target site and the experimental integration site. In subsequent molecular biology steps, PCR amplification with user-defined primer pairs whose primer binding sites are the target site itself and the transposon end sequence, can be used to generate large libraries of sequences in which the internal 49-bp 'insert' is unknown but may be sequenced in downstream steps by NGS.

Example 6

Inactivation of Microbial Antibiotic Resistance Genes Via Programmable RNA-Guided DNA Integration The global rise of antibiotic resistance in bacteria is resulting in fewer methods for treatment of previously controllable infections. As traditional development of antibiotics slows, focus has started to shift towards developing newer ways of combating drug resistant pathological bacteria. In particular, antimicrobial approaches that can directly target the evolving resistant bacterial genomes has emerged, utilizing sequence-specific DNA targeting made possible with the CRISPR-Cas9 nuclease technology, as well as increasing ease of whole-genome sequencing of resistant strains. However, these methods have certain shortcomings, in particular the strong selection for survivor mutants resistant to Cas9 targeting or nuclease activity, as well as inefficient phage delivery limiting the use to very narrow target species and strains.

As described herein, the coding sequence of bacterial resistance genes are disrupted in vivo by insertion of a DNA sequence, leading to non-selective re-sensitization to drug treatment. This approach utilizes the herein described programmable system comprising molecular machineries encoded by the *V. cholerae* HE-45 transposon, also known as Tn6677, and sometimes referred to as *V. cholerae* Tn7-like transposon or Tn7 transposon, which enables site-specific RNA-guided insertion of a user-defined genetic cargo. In addition to disruption of resistance genes, the system can further propagate itself along with the target plasmid. Furthermore, by including spacers targeting bacterial genomes, the construct can also stably insert itself in "safe haven" genomic regions, allowing for stable maintenance of the system and prolonged immunity. Overall, demonstrating the utility of a platform for genomic engineering within complex bacterial consortia and immunization of a complex bacterial community against antibiotic resistance.

Figure 39A:
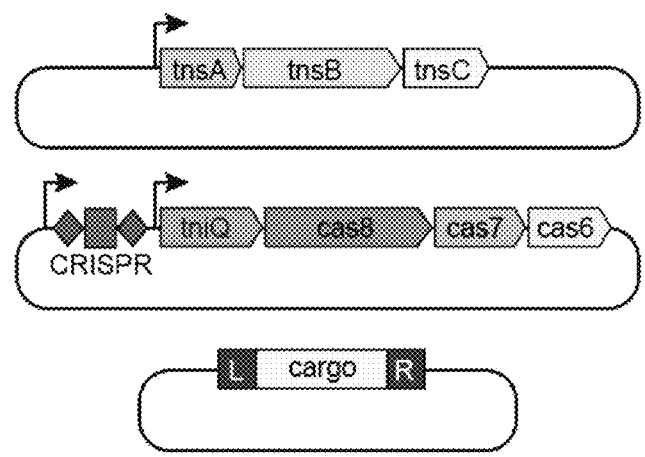
FIGS. 39A-39B are different exemplary plasmid designs for expression of protein and RNA components necessary for RNA-guided DNA integration.
Figure 39B:
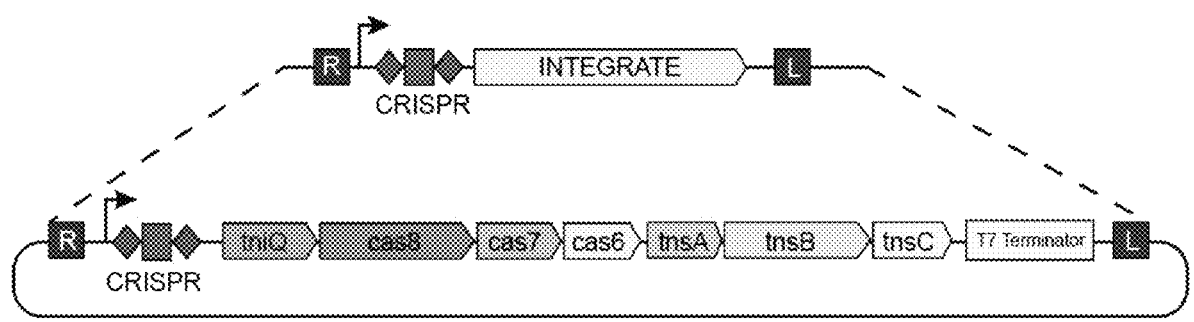

Using a three-plasmid expression strategy (FIG. 39A) for programmable RNA-guided DNA transposition, the seven genes are expressed in two operons on two separate plasmids driven by IPTG-inducible T7 promoters, and the DNA donor containing a cargo of interest is contained on a third. While this initial approach offered high modularity for studying of the mechanism, here the construct is simplified in order to efficiently deliver and express the system for downstream applications. The redesigned all-in-one plasmid (FIG. 39B) expresses all the essential components for transposition on a single continuous transcript, under the control of one promoter. Encoding the entire construct within the transposon ends allows for dissemination with the cargo as transposition occurs in vivo. This construct is capable of efficient transposition as previously shown by transforming *E. coli* BL21(DE3) cells with the construct and quantifying the level of integration activity using targeted qPCR.

Since maintaining high levels of expression of the construct on high-copy plasmids may be unfavorable for efficient integration, the dependence of activity on expression level and backbone copy number is determined. The T7 promoter is substituted with constitutive *E. coli* promoters with a range of expression levels (Yan and Fong, *J Biol Eng*. 2017; 11:33), and the previously used high-copy-number pUC19 backbone is substitute with other backbones that maintain variable copy numbers. With this panel, the broad-host mobilizable vector pBBR1 (Szpirer et al. *J Bacteriol*. 2001; 183(6):2101-2110) and broad-host promoters described in a recent metagenomic mining study (Johns et al., *Nat Methods*. 2018; 15(5):323-329), which are useful for expressing the system in a multi-species context in later stages, are also included. The efficiencies of constructs within this panel are determined with qPCR.

"Cut-and-paste" transposition, where the donor DNA is fully excised from the donor site and inserted at the target location (Bainton et al., Cell, 1991; 65 (5), pp. 805-816), is supported. Thus, when multiple spacers or target sites are available, or through possible constant excision by the transposon machinery, the integrated cargo may be lost from the gene it is disrupting. If an original copy of the gene is present elsewhere in the cell, this leads to possible recapitulation of the original gene sequence through homologous recombination repair (Hagemann and Craig, *Genetics*. 1993; 133(1):9-16).

Figures 40, 41:
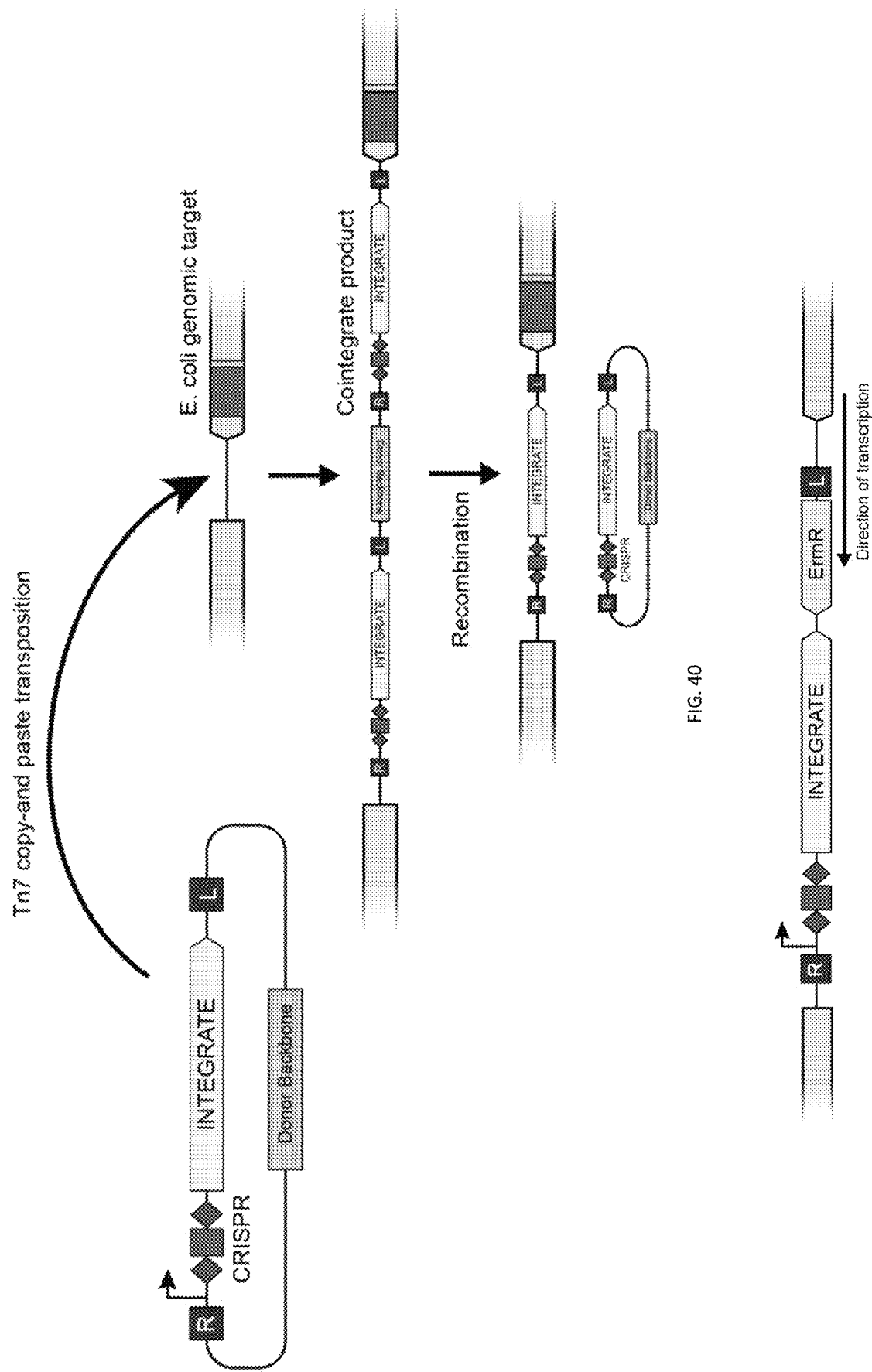
FIG. 40 is a schematic of the formation of the cointegrate product by replicative copy-and-paste transposition, and eventual resolution into the final products by homologous recombination.
FIG. 41 is a schematic of the design of an expanded construct selectable using erythromycin resistance (ErmR), which is expressed only after the construct is integrated into a transcribed genomic locus.

With a single point mutation in the TnsA active site (D114A) of the *E. coli* Tn7 transposon, DNA breakage has been shown to only occur at the 3' end of each strand of the donor (May and Craig. *Science*, 1996; 272(5260):401-4). Without full excision of the donor DNA, the system switches to a replicative copy-and-paste mechanism, resulting in a cointegrate product that eventually is resolved by recombination to yield two identical copies of the cargo (FIG. 40).

This copy-and-paste mechanism is recapitulated using a similar mutation (D90A) in the *V. cholerae* TnsA protein, previously shown to support active transposition. By targeted PCR and sequencing of the product, the existence of the cointegrate product is shown. Using a similar targeted PCR approach characterizes resolution of this product by probing for the existence of a single inserted cargo at the genomic target site, either in a heterogeneous population cells, or by continuous culturing of a clonal cointegrate colony over time. In another embodiment, in order to increase the efficiency recombination and resolution of the cointegrate product, a site-specific recombinase such as Cre or CinH, is included in the cargo, along with its recognition sequence. In naturally occurring replicative transposons such as Tn3 and Mu, this recombinase-assisted strategy has been shown to be utilized for resolution of the cointegrate (Nicolas et al. *Microbiology Spectrum*. 2015; 3(4)).

In addition, the efficiency of multiplexed integration is determined using this approach. In one embodiment, inclusion of multiple spacers in the targeting CRISPR array leads to simultaneous integration events at all of the respective target sites. By delivering the construct on a temperature-sensitive plasmid, curing the plasmid from the cells, and then introducing a second plasmid containing an identical copy of the target site, an integrated genomic copy of the cargo self-mobilizes and copies onto a target plasmid. Clones with simultaneous integration are isolated at both sites.

Resistance Gene Disruption and Immunization in Multiple Bacterial Species

Figure 42:
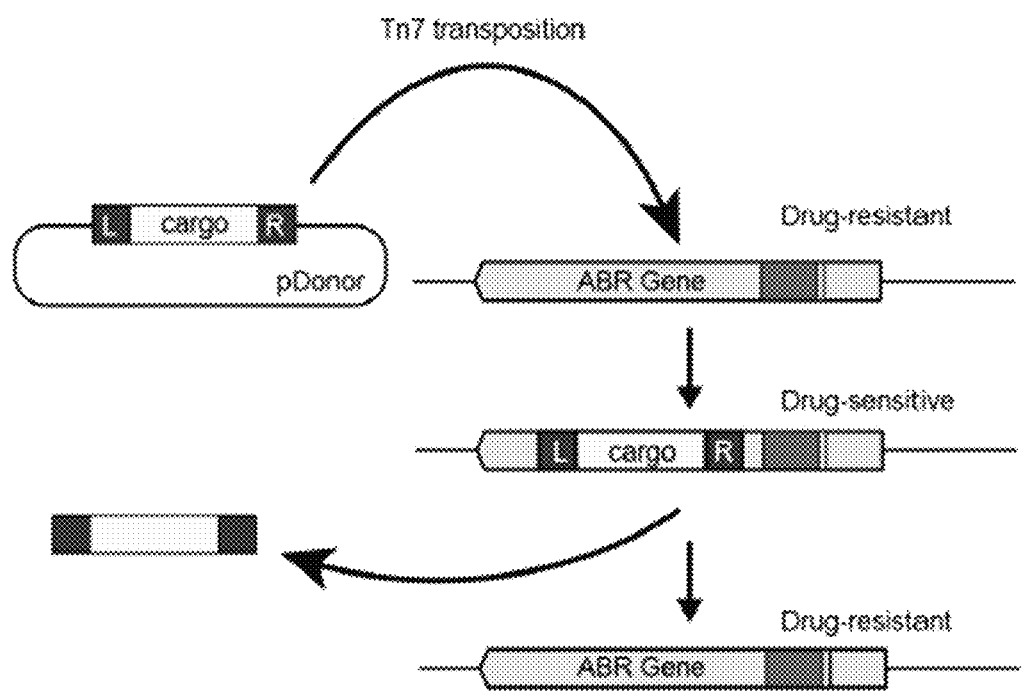
FIG. 42 is a schematic of an exemplary method of modulating antibiotic resistance.

Here integration of a cargo into an antibiotic resistance gene leads to re-sensitization of the cell to antibiotic treatment is demonstrated (FIG. 42). In one embodiment, kanamycin resistant (KanR) BW25113 *E. coli* is transformed with an RNA-guided DNA Integration construct containing a spacer targeting the KanR gene. This experiment is repeated both in cells with a genomic copy of the KanR gene, and in cells with the KanR gene maintained on a stable, ampicillin selectable plasmid. Cells lose kanamycin resistance compared to control cells receiving a construct with a non-targeting gRNA, as determined by selective agar plating and CFU quantifications. Integration and disruption of the coding sequence is confirmed by targeted PCR and sequencing. Furthermore, these cells remain viable and robust by co-culturing with control cells over multiple generations, with comparable growth ratios. The target plasmid containing the disrupted KanR remains stably maintained in cells, and can be extracted and transformed into naïve cells. By apply the multiplexing capability and using different combination of spacers in the gRNA array, cells containing an ampicillin-selectable plasmid harboring both kanamycin and spectinomycin resistance genes become re-sensitized to treatment with either or both of these drugs.

In another embodiment of the invention, when stably maintained on a plasmid in *E. coli*, the RNA-guided DNA Integration machinery disrupts antibiotic-resistance genes introduced during subsequent transformation events. Using similar assays as before, RNA-guided DNA Integration machinery does not block transformation of the plasmid, but that cells fail to acquire resistance to drug treatment and thus are effectively immunized, as compared to cells containing a non-targeting system.

Expanding on this embodiment, RNA-guided DNA Integration machinery is inserted into the genome by the addition of a genomic targeting spacer and this inserted genomic copy of the system is capable of disrupting transformed resistance genes.

In order to apply the system to a complex bacterial population such as the intestinal flora, whether the system can support active transposition in several species of bacteria is investigated using the standard transformation and qPCR assay described herein. In one embodiment, an initial panel of bacteria includes laboratory cultured strains of *E. coli, S. enterica, V. cholerae*, and *P. aeruginosa*, which are all phylogenetically related gram-negative, common gut colonizing species that also have been previously shown to efficiently receive conjugative plasmids from E. coli donors. The RNA-guided DNA Integration machinery construct used for these experiments utilizes broad-host-range backbones and promoters. Multiple different "safe-harbor" loci within each species are screened to determine sites that allow for high integration efficiency and are sufficiently conserved between multiple strains of each species. These sites serve as stable genomic integration sites for the maintenance of the system into their respective species in vivo in later stages. The ability to isolate genomic-integrated clones is evaluated by inserting a conditionally expressed erythromycin resistance (ErmR) coding sequence (FIG. 41).

In Vivo Immunization of the Gut Flora

The RNA-guided DNA integration machinery construct is delivered by conjugation and test efficiency using an auxotrophic donor E. coli strain containing RP4 conjugation machinery, following the previously described method. Following a direct conjugation assay between the donor and each individual recipient strain, growth on selective media is used to confirm successful conjugation. In order to recapitulate the immunization experiment, both the RNA-guided DNA Integration machinery plasmid, as well as an ampicillin-selectable target plasmid containing the target KanR cassette are simultaneously delivered via conjugation to each recipient strain. By selecting for successful double-transconjugants, immunization against drug resistance is demonstrated. The experiment is performed separately under aerobic and anaerobic growth conditions post-conjugation. Other embodiments take a similar approach but use different plasmid backbones aimed at conjugating into more bacterial species or use a library of plasmids that comprise a panel of different backbones.

In one embodiment, the activity of the system when delivered to a mixture of bacteria is evaluated. The conjugation and immunization experiments described above are recapitulation using an equal mixture of each of the four species previously evaluated. Double-transconjugants recovered are evaluated for kanamycin sensitivity, and 16S rRNA sequencing is also utilized to confirm the presence of all four recipient species.

In a further embodiment, the method is applied to gut bacteria freshly isolated from C57BL/6 mouse feces. Gut bacteria are isolated as a complex mixture of multiple different species, under anaerobic conditions, and conjugation assays are carried out as previously described (Ronda et al. Nat Methods 16:167-170, 2019). The ability to deliver via conjugation either the RNA-guided DNA Integration machinery plasmid, or the KanR-target plasmid, and then both simultaneously is evaluated. At each stage, transconjugants are selected and the recipient species are determined via 16S rRNA sequencing. In a further embodiment, stable insertion of RNA-guided DNA Integration machinery into the genome of isolated gut bacteria is demonstrated. Spacers are added to the array targeting multiple different genomic sites, as well as an ErmR gene into the cargo, and this expanded RNA-guided DNA Integration machinery construct is delivered by conjugation to extracted gut bacteria. Stably integrated bacteria are selected on erythromycin media and sequenced to confirm their phylogenetic identities.

The system's ability for in vivo immunization of the mouse gut microbiome is demonstrated using the expanded and genome-insertable RNA-guided DNA Integration machinery construct, targeting KanR. In one embodiment, the construct and KanR target plasmid are simultaneously introduced using two separate E. coli donor populations into the mouse gut via oral gavage, and bacteria is isolated from feces periodically afterwards. Controls include a construct without a KanR targeting spacer, and a construct without spacers targeting genomic sites. The latter leads to higher immunization against kanamycin resistance compared to the former, but a full system with spacers targeting both leads to even more effective immunization. By 16S analysis of transconjugants, taking advantage of the target plasmid for further dissemination allows genome-targeting RNA-guided DNA Integration machinery constructs with a KanR spacer to spread more effectively, as compared to constructs without a KanR spacer. In a further embodiment, the immunization experiment is repeated with delivery of the RNA-guided DNA Integration machinery construct into the mice preceding delivery of the KanR target.

The method described in this Example utilizes a programmable DNA integrase. This system, which originates from a Vibrio cholerae strain, leverages four Tn7-associated and the CRISPR-associated genes for specific integration of a DNA cargo at a target location (Klompe et al., Nature 571, 219-225 (2019), incorporated herein by reference). By demonstrating that targeting of the integrase can be defined by changing the spacer sequence encoded within the associated gRNA array, the system can be adapted into a highly programmable DNA insertion tool, Insertion of Transposable Elements by Guide RNA-Assisted Targeting (INTEGRATE).

Applying INTEGRATE allows one to specifically target and insert a DNA cargo into the coding sequence of antibiotic resistance genes, thereby disrupting its expression without generating lethal DSBs. Using this strategy, antibiotic resistance is combated without causing cell death, thereby avoiding the simultaneous selection for survivor mutants. By using a conjugative plasmid strategy similar to the MAGIC system described by the Harris Wang lab (Ronda et al., Nat Methods 16:167-170, 2019, incorporated herein by reference), the system is delivered to the model mouse gut microbiome, whereby the system inserts stably into the genomes of several species and serves as a surveillance tool. This causes the cell to be effectively immunized against becoming resistant to drug selection from horizontally inherited resistance genes (Blair et al., Nature Reviews Microbiology, 13, 42-51 (2015), incorporated herein by reference). Furthermore, by converting INTEGRATE to a replicative mode of action and including the entire INTEGRATE machinery on the cargo, the system copies itself from the donor to the target resistance gene, and thus propagate itself further along with any subsequent horizontal transfer of the target plasmid. Once introduced into a new cell, spacers in the gRNA array targeting genomic sites lead to insertion of a copy of the construct stably in the genome, completing the cycle. Thus, by hijacking the natural horizontal transfer of antibiotic resistance genes, the approach addresses the problem of effective delivery, while simultaneously exerting its intended interference effect.

The strategy to combat antibiotic resistance using INTEGRATE tackles resistance spreading in a complex bacterial population. This project also demonstrates the utility of programmable transposition via INTEGRATE for microbial engineering applications. For example, the approach can be easily redesigned to target and eliminate virulence genes from the population, to perform in situ gene knockouts, or to stably introduce new genetic elements to the metagenomic pool of a microbiome.

By non-lethal disruption of antibiotic resistance genes, the method circumvents challenges with survivor selection and exploits secondary propagation of the construct. Beyond resistance genes, this method may be redesigned to target any set of genes, such as virulence or metabolic genes, for clinical and industrial applications in other embodiments.

Example 7

Methods for Programmable RNA-Guided DNA Integration in Plants

Targeted Mutation of a Mitogen-Activated Protein (MAP) Kinase Gene in Rice (a Monocot Cereal Crop)

The short PAM sequence is present in the plant genome at high frequency (for example, 141 PAMs were found in 1110 by coding region of the OsMPK5 gene), suggesting the possibility of targeting and editing of every plant gene using this method. Three 20-22 nt guide RNAs (gRNAs) are designed to target three specific sites of a mitogen-activated protein kinase gene in rice genome. Two RNA-guided Genome Editing vectors (pRGE3 and pRGE6) are created for expressing the components of the present system in plant cells. In both vectors, CaMV 35S promoter is used to control the expression of one or more proteins/enzymes which is fused with a nuclear localization signal and a FLAG tag. The pRGE3 and pRGE6 vectors contain: (1) a DNA-dependent RNA polymerase III (Pol III) promoter (rice snoRNA U3 or U6 promoter, respectively) to control the expression of gRNA molecules in the plant cell, where the transcription was terminated by a Pol III terminator (Pol III Term); (2) a DNA-dependent RNA polymerase II (Pol II) promoter (e.g., CaMV 35S promoter) to control the expression of one or more proteins/enzymes; (3) a multiple cloning site (MCS) located between the Pol III promoter and gRNA scaffold, which is used to insert a 15-30 nt DNA sequence encoding a gRNA. For the *Agrobacterium tumefaciens*-mediated transformation, the transposon-encoded CRISPR-Cas system cassettes from pRGE3 and pRGE6 are inserted into the T-DNA region of pCambia 1300 vector, respectively, to produce pRGEB3 and pRGEB6.

To demonstrate RNA-guided genome editing in plants, the OsMPK5 gene which encodes a stress-responsive rice mitogen-activated protein kinase is used for targeted mutation by the present system. Three guide RNA (gRNA) sequences are designed based on the corresponding target sites in the OsMPK5 locus (PS1, PS2 and PS3). The PS1-gRNA (22 nt) is specific for the template strand of OsMPK5. The PS2- and PS3-gRNA (20 and 22 nt, respectively) are specific for the coding strand of OsMPK5. Subsequently, three gRNA-Cas9 constructs are made by inserting the synthetic DNA oligonucleotides which encode the gRNAs into the pRGE3 vector.

Rice protoplast transient expression system is used to test the engineered gRNACas9 constructs. The efficient transformation of rice protoplasts is demonstrated with a plasmid construct carrying the green fluorescence protein (GFP) marker gene. Fluorescence microscopic analyses for GFP expression in protoplasts is conducted about 18 hours after transformation and about 36-72 hours after transformation. PCR and/or sequencing is performed to confirm the genome editing. To estimate the efficiency of genome editing, T7 endonuclease I (T7E1) assay is performed to detect mutation for all three targeted sites in the OsMPK5 locus. In this assay, amplicons encompassing targeted sites are amplified from genomic DNA and treated with mis-match sensitive T7E1 after melting and annealing, and cleaved DNA fragments would be detected if amplified products containing both mutated and wild type DNA.

Stable transgenic rice lines are generated expressing the present system via the *Agrobacterium*-mediated transformation. The transgenic rice plants expressing PS1-gRNA (TG4lines) and PS3-gRNA (TG5 lines) are examined by T7E1 assay, PCR and sequencing.

Materials and Methods

Construction of RNA-Guided Genome Editing Vectors for the Plant System

To construct pRGE3 and pRGE6 vectors, rice snoRNA U3 and U6 promoters are amplified from rice cultivar Nipponbare genomic DNA using primer pairs. The DNA sequence encoding the gRNA scaffold are amplified from the pX330 vector using a pair of primers. The PCR product of U3 or U6 promoter and gRNA scaffold re fused by overlapping PCR. The U3 or U6 promoter-gRNA fragment are then cloned into the Hind III site of pUGW11-BsaI vector through the Giboson assembly method to produce pUGW-U3-gRNA and pUGWU6-gRNA. pUGW11-BsaI is derived from pUGW11 by removing two Bsa I sites in Amp resistance gene and 35S promoter using site-directed mutangenesis (Strategene). The sequences encoding the proteins/enzymes of the present system are subsequently introduced into pUGW-U3-gRNA or pUGW-U6-gRNA by LR reaction (Invitrogen), resulting in the pRGE3 and pRGE6 vector. In addition, two binary vectors (pRGEB3 and pRGEB6) are made by inserting the transposon-encoded CRISPR-Cas system cassettes from pRGE3 and pRGE6 into the pCAMBIA 1300-BsaI vector. The pCAMBIA 1300-BsaI is derived from pCAMBIA1300 by removing BsaI sites in the 35S promoter using site-directed mutagenesis (Stratagene).

Gene Targeting Constructs for Precise Disruption of the OsMPK5 Gene

DNA sequences encoding gRNAs are designed to target three specific sites in the exons of OsMPK5. For each target site, a pair of DNA oligonucleotides with appropriate cloning linkers are synthesized. Each pair of oligonucleotides is phosphorylated, annealed, and then ligated into Bsa I digested pRGE3 or pRGE6 vectors. After transformation into *E. coli* DH5-alpha, the resulting constructs are purified with QIAGEN Plasmid Midi kit (Qiagen) for subsequent use in rice protoplast transfection. For stable transformation, the DNA oligo which has been used to construct the PS1-gRNA and PS3-gRNA is inserted into pRGEB3. The resulting gene constructs are introduced into the *Agrobacterium tumefaciense* strain EHA105.

Rice Protoplast Preparation and Transformation

Rice protoplasts are prepared from 10-day-old young seedlings of Nipponbare cultivar (*Oryza sativa* spp. *japonica*) after germination in MS media. The protoplasts re isolated by digesting rice sheath strips in Digestion Solution (10 mM MES pH5.7, 0.5 M Mannitol, 1 mM $CaCl_2$), 5 mM beta-mercaptoethanol, 0.1% BSA, 1.5% Cellulase R10 (Yakult Pharmaceutical, Japan), and 0.75% Macerozume R10 (Yakult Pharmaceutical, Japan)) for 5 hours. After filtering through Nylon mesh (35 um), the protoplasts are collected and incubated in W5 solution (2 mM MES pH5.7, 154 mM NaCl, 5 mM KCl, 125 mM $CaCl_2$)) at room temperature ($25_0C$) for 1 hour. The W5 solution is then removed by centrifugation at 300×g for 5 min, and rice protoplasts are resuspended in MMG solution (4 mM MES, 0.6 M Mannitol, 15 mM $MgCl_2$) to a final concentration of $1.0 \times 10_7$/ml. For transformation, 10 ul of plasmids (5-10 ug) is gently mixed with 100 ul of protoplasts and 110 ul of PEG-$CaCl_2$) solution (0.6 M Mannitol, 100 mM $CaCl_2$) and 40% PEG4000), and then incubated at room temperature for 20 min. Transformation are stopped by adding 2× volume of W5 solution.

Transformed protoplasts are collected by centrifugation and resuspended in WI solution (4 mM MES pH5.7, 0.6 M Mannitol, 4 mM KCl). The transformed protoplasts are maintained in 24-well culture plates. After 24-72 hours of incubation in WI solution, protoplasts are collected by centrifugation at 300×g for 2 min and frozen in ~80° C.

Agrobacterium-Mediated Rice Transformation

Embryogenic calli derived from seeds of Nipponbare cultivar are used for the Agrobacterium-mediated stable transformation according to the previously described method (Xiong and Yang, The Plant Cell, 2003, 15:745-759).

Genomic DNA Extraction

Genomic DNA is extracted from rice protoplasts or seedling leaves by adding 100 µl of pre-heated CTAB buffer and incubated at 65° C. for 20 min. 40 µl of chloroform is then added; the resulting mixtures are incubated at room temperature (25° C.) in an end-to-top rocker for 20 min. After centrifugation at 16000×g for 5 min, the supernatant is transferred to a new tube and mixed with 250 µl of ethanol. Following incubation on ice for 10 min, genomic DNA is precipitated by centrifugation at 16000×g for 10 min at room temperature. The DNA pellet is washed with 0.5 ml of 70% ethanol and air dried. The genomic DNA is then dissolved in 100 µl of dH$_2$O and its concentration is determined by spectrophotometer.

T7 Exonuclease I Assay

To detect mutation by T7 exonuclease I (T7E1) assay, the DNA fragments containing the targeted sites are amplified from genomic DNA using a pair of primers and Phusion High-Fidelity DNA Polymerase (NEB). The PCR product is purified using PCR Purification Column (Zymo Research) and the concentration is determined with a spectrophotometer. 100 ng of purified PCR product is then denatured-annealed under the following condition: 95° C. for 5 min, ramp down to 25° C. at 0.1° C./sec, and incubate at 25° C. for additional 30 min. Annealed PCR products are then digested with 5 U of T7E1 for 2 hours at 37° C. The T7E1 digested product is separated by 1% agarose gel electrophoresis and stained with ethidium bromide. The intensity of DNA bands is calculated using Image J software.

Genome Editing in Potato (Solanum tuberosum, a Dicot Food Crop)

Guide RNAs are designed to target the potato asparagine synthase gene (StAS1). The present system is delivered into potato leaf protoplasts via transient expression. One Solanum tuberosum Genome Editing vector (pStGE3) is created to express engineered gRNA targeting a potato gene and the other components of the present system. The pStGE3 vector contains several important functional elements: (1) a DNA-dependent RNA polymerase III (pol III) promoter (Arabidopsis U3 promoter) to control the expression of engineered gRNA targeting potato genes in the plant cell, where the transcription will be terminated by a Pol III terminator (Pol III Term); (2) a DNA-dependent RNA polymerase II (pol II) promoter (CaMV 35S promoter) to drive the expression of proteins/enzymes; and (3) a cloning site located between the Pol III promoter and gRNA scaffold, which will be used to insert a DNA sequence encoding the gRNA. In addition, a binary vector suitable for the Agrobacterium-mediated transformation is also constructed by inserting the transposon-encoded CRISPR-Cas system cassettes as those of pStGE3 into the T-DNA region in the pCAMBIA 1300 vector.

StAS1 was previously identified and characterized to regulate the accumulation of acrylamide in potato products such as French fries and potato chips. Therefore, a successful targeted mutation of StAS1 will significantly decrease the asparagine content in potato, leading to a reduction of acrylamide present in the processed potato products. Two guide RNA (gRNA) sequences are designed based on the corresponding target sites in the StAS1 gene (PS1 and PS2). The Ps1-gRNA (20 nt) is designed to pair with the template strand of StAS1. The Ps2-gRNA (20 nt) pairs with the coding strand of StAS1. Subsequently, DNAs encoding PS1 and PS2 are inserted into the pStGE3 vector.

Protoplast transient expression system is used to test the PS1 and PS2 genome editing constructs. A simple and efficient procedure for the isolation and regeneration of protoplasts from tube potatoes was established previously, and a PEG-mediated transient transformation method has also been developed. Isolation and transfection of potato protoplasts is demonstrated using a plasmid construct carrying the green fluorescence protein (GFP) gene.

To detect the gRNA-guided genomic editing in protoplasts, potato genomic DNA is extracted from the transfected protoplasts at 24 hours after transformation. The extracted DNA is analyzed by PCR and/or sequencing.

Plant Materials

Four- to six-week-old potato plants re grown in a greenhouse (23-25° C.). Solanum tuberosum DM1-3 516 R44 (referred to as DM), the sequenced cultivar from doubled monoploid clone derived classical tissue culture, is obtained.

Gene Constructs for Targeted Gene Mutation

DNA sequences encoding gRNAs are designed to target two specific sites in the exons of StAS1. For each target site, a pair of DNA oligonucleotides with appropriate cloning linkers are synthesized. Each pair of oligonucleotides is phosphorylated, annealed, and then ligated into BsaI digested pStGE3 vectors. After transformation into E. coli DH5-alpha, the resulting constructs are purified with QIAGEN Plasmid Midi kit (Qiagen) for subsequent use in potato protoplast transformation.

Potato Protoplast Preparation and Transformation

Potato protoplasts are prepared from 4- to 6-week-old potato leaves of DM cultivar (Diploid Solanum tuberosum). Potato leaves are first incubated in conditional medium containing 1×MS, 100 mg/L Casein hydrolysate, 3 mM MES pH 5.7, 0.35 M Mannitol, 2 mg/L NAA and 1 mg/L BA. Then the protoplasts are isolated by digesting these potato leaves in Digestion Solution (1×MS, 3 mM MES pH5.7, 0.3 M Mannitol, 1 mM CaCl$_2$, 5 mM betamercaptoethanol, 0.2% BSA, 1% Cellulase R10 [Yakult Pharmaceutical, Japan], and 0.375% Macerozume R10 (Yakult Pharmaceutical, Japan)) for 3.5 hours. After filtering through Nylon mesh (35 µm), the protoplasts are washed by W5 solution (2 mM MES pH5.7, 154 mM NaCl, 5 mM KCl, 125 mM CaCl$_2$) at room temperature (25° C.) 3-5 times and then collected and incubated in W5 solution for 30 minutes. The W5 solution is then be removed by centrifugation at 300×g for 3 min, and potato protoplasts are resuspended in MMG solution (4 mM MES, 0.6 M Mannitol, 15 mM MgCl$_2$) to a final concentration of 5.0×10$^6$/ml. For transformation, 10 µl of plasmids (5-10 µg) are gently mixed with 100 µl of protoplasts and 110 µl of PEG-CaCl$_2$) solution (0.6 M Mannitol, 100 mM CaCl$_2$) and 40% PEG4000), and then incubated at room temperature for 20 min. Transformation is stopped by adding 2× volume of W5 solution. Transformed protoplasts are then collected by centrifugation and resuspended in W5 solution. The transformed protoplasts re maintained in 24-well culture plates. After 24-48 hours of incubation in W5 solution, protoplasts are collected by centrifugation at 300×g for 2 min and frozen in −80° C. for further analysis.

Genomic DNA Extraction

Genomic DNA is extracted from potato protoplasts by adding 150 μl of extraction buffer (200 mM Tris-HCl PH 7.5, 250 mM NaCl, 25 mM EDTA, 0.5% SDS, 10 mg/L Rnase I) and shaking the mixture for 1 min. After centrifugation at 12000 rpm for 5 min, the supernatant is transferred to a new tube and mixed with 150 isopropyl alcohol. Following incubation on ice for 20 min, genomic DNA is precipitated by centrifugation at 12000 rpm for 15 min at 4° C. The DNA pellet is washed with 0.5 ml of 70% ethanol and air dried. The genomic DNA is then dissolved in 80 μl of $H_2O$ and its concentration is determined by spectrophotometer.

Genome Modification in Maize Plants

Genes encoding the proteins/enzymes of the present system are maize codon optimized per standard techniques known in the art and the potato ST-LS1 intron is introduced in order to eliminate its expression in E. coli and Agrobacterium. To facilitate nuclear localization of the proteins/enzymes in maize cells, Simian virus 40 (SV40) monopartite amino terminal nuclear localization signal and Agrobacterium tumefaciens bipartite VirD2 T-DNA border endonuclease carboxyl terminal nuclear localization signal is incorporated at the amino and carboxyl-termini of the open reading frame, respectively. The maize optimized gene is operably linked to a maize constitutive or regulated promoter by standard molecular biological techniques.

To confer efficient guide RNA expression (or expression of the duplexed crRNA and tracrRNA) in maize, the maize U6 polymerase III promoter and maize U6 polymerase III terminator residing on chromosome 8 is isolated and operably fused to the termini of a guide RNA.

Targeted Mutation of AtPDS3 in Arabidopsis Via the Agrobacterium tumefaciens-Mediated Transformation Two gRNAs are designed to target two distinct sites in the coding region of AtPDS3 which encodes the Arabidopsis phytoene dehydrogenase. Plants defective in AtPDS3 display leaf bleaching phenotype, which makes it easy to examine gene knock-out efficiency. Two DNA sequences encoding the gRNAs are synthesized and cloned into pRGEB3 and pStGEB3, respectively.

Two sets of RGE vectors are used for targeted mutagenesis of AtPDS3 in Arabidopsis using the Agrobacterium tumafaciens-mediated floral dip method. One contains the 35S promoter-driven proteins/enzymes and rice U3 promoter-driven gRNA in pRGEB3, while another contains the 35S promoter-driven proteins/enzymes and Arabidopsis U3 promoter-driven gRNA in pStGEB3. Following the Agrobacterium-mediated transformation, 30-40 transgenic Arabidopsis lines are analyzed.

Example 8

Methods for Programmable RNA-Guided DNA Integration in Animal Cells

Testing of Transposon-Encoded CRISPR-Cas System in Porcine Cells

Porcine kidney PK15 cells are cultured in high glucose DMEM (Life Technologies, #31966) supplemented with 10% fetal bovine serum, 100 U/ml penicillin and 100 μg/ml streptomycin in a humidified incubator at 37° C. with 5% $CO_2$.

Potential small guide RNA target sites are initially identified based on the presence of protospacer adjacent motifs (PAM) within the coding sequence of the porcine gene of interest.

Plasmids encoding the sgRNA sequence, other components of the present system and a CMV-driven eGFP are co-transfected into $6 \times 10^5$ PK15 cells using a Neon electroporator set at 2 pulses of 1400 mV for 20 ms each. Transfected cells are recovered in complete medium without antibiotic. Three days post transfection GFP positive cells are isolated by fluorescence activated cell sorting, expanded by culturing and genomic DNA prepared using the Qiagen DNeasy Blood and Tissue kit. PCR is carried out on this genomic DNA using Accuprime High Fidelity polymerase. Cell analysis is carried out on the PCR products as recommended by the manufacturer (Transgenomic). Digested PCR products are resolved on a 2% TAE agarose gel.

Testing of Transposon-Encoded CRISPR-Cas System in Bovine Cells

Potential target sites for sgRNAs are initially identified based on the presence of PAM sequences within either the coding sequence of the bovine gene of interest or the sequence immediately flanking the coding sequence. Nine potential sgRNA-binding sites are selected (three 5' to the coding sequence, three within the coding sequence, and three 3' to the stop codon).

For each identified sgRNA binding site, two guide sequences re designed; a 20-mer binding sequence, and a 19-, 18- or 17-mer binding sequence.

One microgram of plasmid miniprep DNA (Qiagen) encoding components of the present system is transfected into $6 \times 10^5$ bovine embryonic fibroblast cells (BEF) using a Neon electroporator set at a single pulse of 1800 mV for 20 ms. Two days post transfection genomic DNA is prepared using the Qiagen DNeasy Blood and Tissue kit. PCR is carried out on this genomic DNA using Accuprime High Fidelity polymerase.

T7 endonuclease analysis is carried out on purified PCR products as recommended by the manufacturer (NEB). Digested PCR products are resolved on a 1.4% TAE agarose gel.

Transposon-Encoded CRISPR-Cas System for DNA Integration in Porcine Blastocyst

Following successful validation in cell culture, the guide RNA sequence(s) are assembled with a T7 promoter. Assembly with a T7 driven construct helps in vitro transcription and production of RNA. Briefly, sgRNA are transcribed using T7 in vitro transcription kit (Ambion). Likewise, other components of the present system re transcribed using T7 in vitro transcription kit and/or T7 Megascript in vitro transcription kit.

The mRNAs encoding components of the present system (100 ng/L), and sgRNA targeting the porcine gene of interest (50 ng/μL) are injected into 1-cell porcine zygotes using an Eppendorf Femtojet injector on a continuous flow setting. The injected embryos are allowed to progress to blastocyst stage for an additional 6 days, DNA collected, and PCR amplified around the target site. The presence of target gene mutations is assessed by sequencing of the PCR amplicons. The sequence surrounding the target site is amplified using gene specific primers, cloned into PCR2.1 vector (Invitrogen), transformed into DH5α cells (NEB) and transformants selected based on Kanamycin resistance. The colonies are cultured overnight, miniprepped and the plasmids sequenced by Sanger sequencing.

Generation of Genetically Modified Pig Models

The mRNAs encoding components of the present system, and sgRNA targeting the porcine gene of interest are injected into in vitro fertilized porcine embryos. Briefly, maturing oocytes from sows are purchased from ART Inc. (Madison, Wis.) and shipped overnight in their commercial maturation medium #1. Twenty-four hours after being placed in the maturation medium #1 (provided by ART), 50 to 75 cumulus-oocyte complexes (COCs) are placed in 500 µl of tissue culture medium 199 (TCM 199) containing 0.14% PVA, 10 ng/ml epidermal growth factor, 0.57 mM cysteine, 0.5 IU/ml porcine FSH, and 0.5 IU/ml ovine LH and cultured for an additional 20 hours at 38.5° C. and 5% C02 in air, 100% humidity. COCs are vortexed in 0.1% hyaluronidase in HEPES-buffered medium containing 0.01% PVA for 4 minutes to remove the cumulus cells following maturation. Groups of 30-35 mature, denuded oocytes are placed in 100 µL of a modified Tris-buffered medium (mTBM) and fertilized according to an established protocol using fresh extended boar semen. Briefly, 1-2 ml of extended semen are mixed with Dulbecco's Phosphate Buffered Saline (DPBS) containing 1 mg/ml BSA to a final volume of 10 ml and centrifuged at 1000×g, 25° C. for four minutes; spermatozoa are washed in DPBS for a total of three times. After the final wash, spermatozoa are resuspended in mTBM medium and added to oocytes at a final concentration of $5 \times 10^5$ spermatozoa/ml, and co-incubated for 5 hours at 38.5° C. and 5% $CO_2$. Five hours following fertilization, the presumptive zygotes re injected with mRNAs encoding components of the present system, and sgRNA, and the intact embryos are surgically transferred into the oviducts of synchronized female recipient animals by exposing the reproductive tract by midline incision. Animals are allowed to recover from surgery.

Another alternative is to use in vivo fertilized 1-cell embryos for CRISPR mediated targeting of NANOS2 and generation of edited animals. Embryo donor animals are synchronized for estrus and superovulated by first feeding with Regumate (Alterenogest) for 14-16 days, followed by subcutaneous injections of PG600 (5 ml) on day 17 and 1000 IU of hCG on day 20. Animals are bred thrice, once on standing estrus (day 20), and two more inseminations 8 hours apart on day 21. Animals are humanely slaughtered on day 22 and the embryos are harvested by flushing the oviduct. Embryos are injected with mRNAs encoding components of the present system, and sgRNA, and surgically transferred into synchronized recipient (or surrogate) animals the same day as described above.

Generation of Genetically Modified Animals Via Embryo Injections

A candidate sgRNA targeting a porcine gene of interest is designed. The mRNAs encoding components of the present system, and sgRNA targeting the porcine gene of interest are in vitro transcribed using T7 mMessage Machine kit (Ambion), cleaned by Megaclear Kit (Ambion) and injected into in vivo fertilized porcine 1-cell embryos. A cohort of 12 animals of 8-9 months of age are synchronized for estrus and used in the experiment. Eight of the synchronized animals are bred to serve as embryo donors, whereas the remaining 4 animals are synchronized but not bred to serve as surrogates. Estrus is synchronized by feeding 5 ml of progesterone analog, Regumate (or Matrix) for 14 days. 24 hours (h) after last Regumate feeding, the animals are given a dose of PMSG (1200 IU, Sigma) subcutaneously, and the ovulation is induced 72 h later by administration of HCG (1000 IU, Chorulon, Merck) subcutaneously. The donor animals (n=8) in standing heat are artificially inseminated with boar semen (PIC Genetics). In vivo embryos from donor animals are recovered surgically 24 h after artificial insemination by retrograde flushing with sterile PVA TL-Hepes medium from the oviduct. The in vivo derived embryos are injected with the mRNAs encoding components of the present system, and sgRNA, and cultured in PZM3 medium overnight.

A day after microinjection, 30 embryos are transferred surgically into the oviducts of each surrogate animal.

For embryo transfers, donor and surrogate pigs are anesthetized by a mix of ketamine/xylazine (6.6 mg/kg and 1-2 mg/kg IM) and placed on their back on a surgical table. Adequate depth of anesthesia will be assessed by monitoring heart rate, temperature, full rhythmic respirations, constricted pupil, and reduced or absent palpebral reflex. The reproductive tract of anesthetized gilts is exposed via a midline abdominal incision. Only the oviducts and tips of the uterus are exposed. In donors, embryos are retrograde flushed through the utero-tubal junction, and the embryos collected from ostium of oviduct. For embryo transfer into surrogates, a tom-cat catheter containing the embryos is placed through the infundibulum and the embryos are deposited into the oviduct. Following three-layered closure of the incision using absorbable sutures (USP #3 body wall, #3 fat, #1 sub-q), the animals are allowed to recover. Pregnancies are confirmed by lack of return to Estrus (21 days) and ultrasound at 28 days post embryo transfer.

Generation of Genetically Modified Animals Via Somatic Cell Nuclear Transfer (SCNT)

Porcine fetal fibroblasts (PFF) are established from fetuses recovered from D35 pregnant Duroc pigs. A candidate male and female PFF line is nucleofected with CMV promoter driven plasmid(s) encoding components of the present system. One day after nucleofection, the nucleofected cells are sorted singly into each well of a 96-well plate. The cells are fed with irradiated fibroblast conditioned growth medium, and allowed to form colonies. Following a week of culture, colonies begin to appear within the wells. The cells are clonally propagated, and DNA is extracted and screened for mutations using DNA sequencing. The cells that are homozygous for mutation are cloned via somatic cell nuclear transfer to generate genetically modified male and female piglets.

Example 9

Structural Basis of DNA Targeting by a Transposon-Encoded CRISPR-Cas System

Figure 43A:
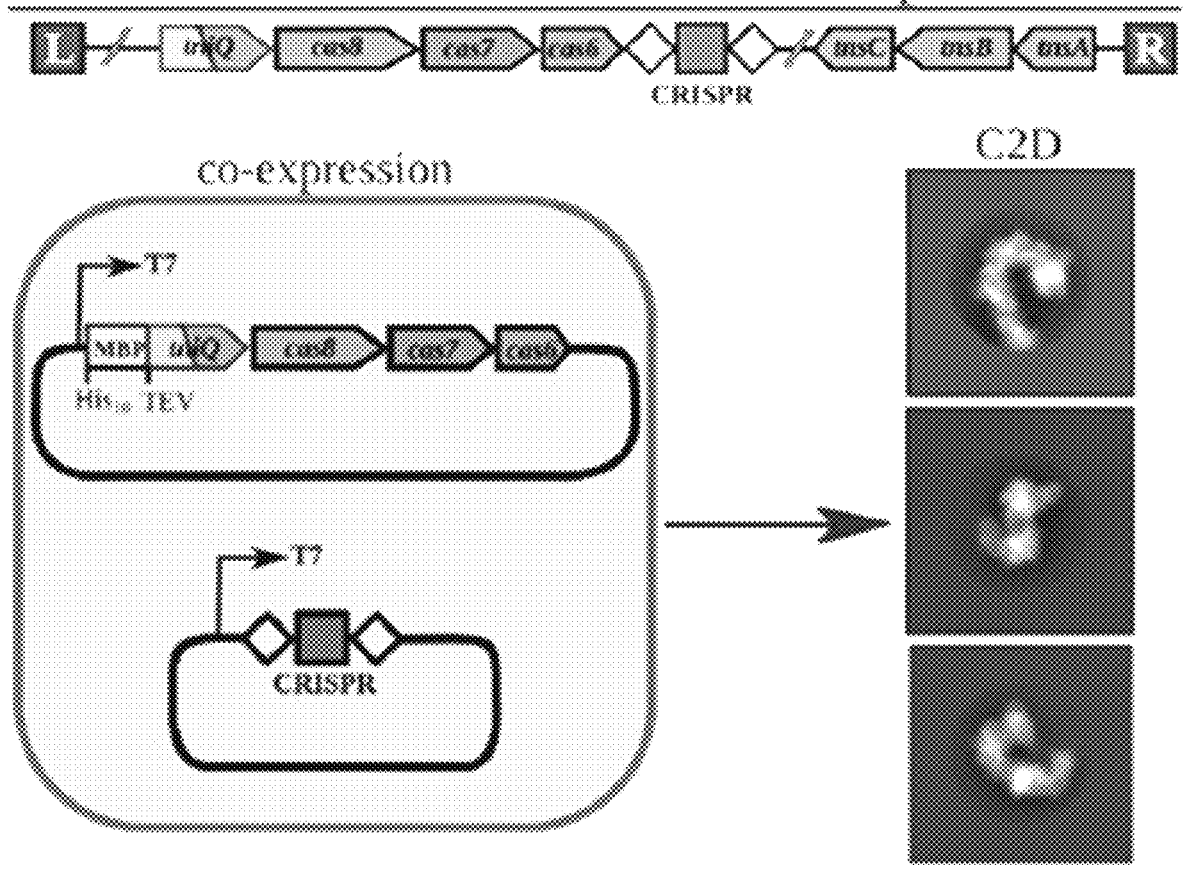
FIGS. 43A-43D are the overall architecture of the *V. cholerae* TniQ-Cascade complex.
Figure 43B:
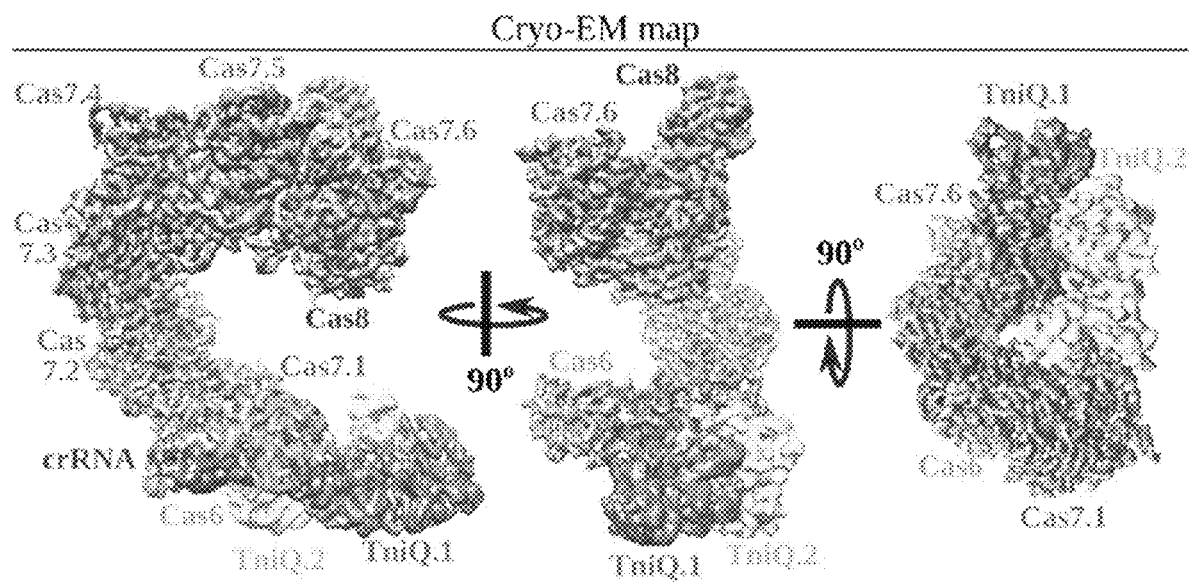

The *Vibrio cholerae* Tn6677 transposon undergoes programmable transposition directed by a CRISPR RNA (crRNA), and this activity uses four transposon- and three CRISPR-associated genes in addition to a CRISPR array (FIG. 43A). Whereas TnsA, TnsB, and TnsC exhibit functions that are consistent with their homologs from a related and well-studied cut-and-paste DNA transposon, *E. coli* Tn7, TniQ, a homolog of *E. coli* TnsD, forms a co-complex with the Cascade ribonucleoprotein complex encoded by the Type I-F variant CRISPR-Cas system. This finding suggested an alternative role for TniQ, as compared to the role of EcoTnsD in identifying target sites during Tn7 transposition. RNA-guided DNA targeting by Cascade may deliver TniQ to DNA in a manner compatible with downstream transpososome formation, and that TniQ might interact with Cascade near the 3' end of the crRNA, consistent with RNA-guided DNA insertion occurring ~49-bp downstream from the PAM-distal edge of the target site.

Figure 43C:
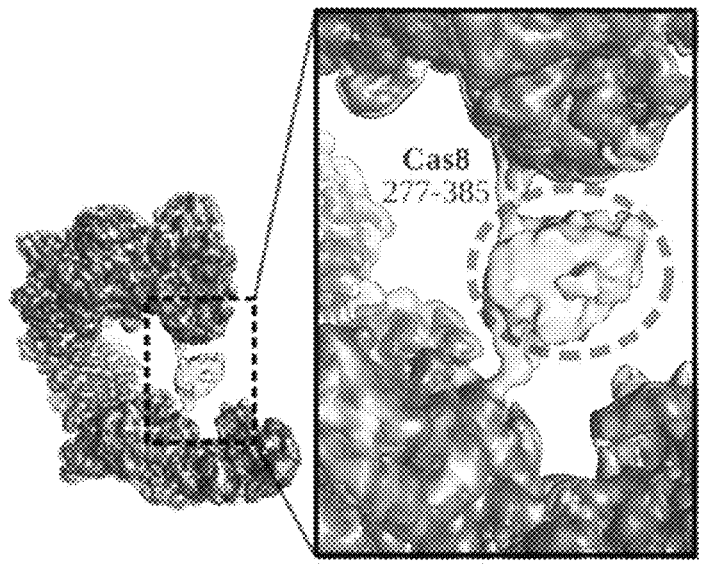
Figure 43D:
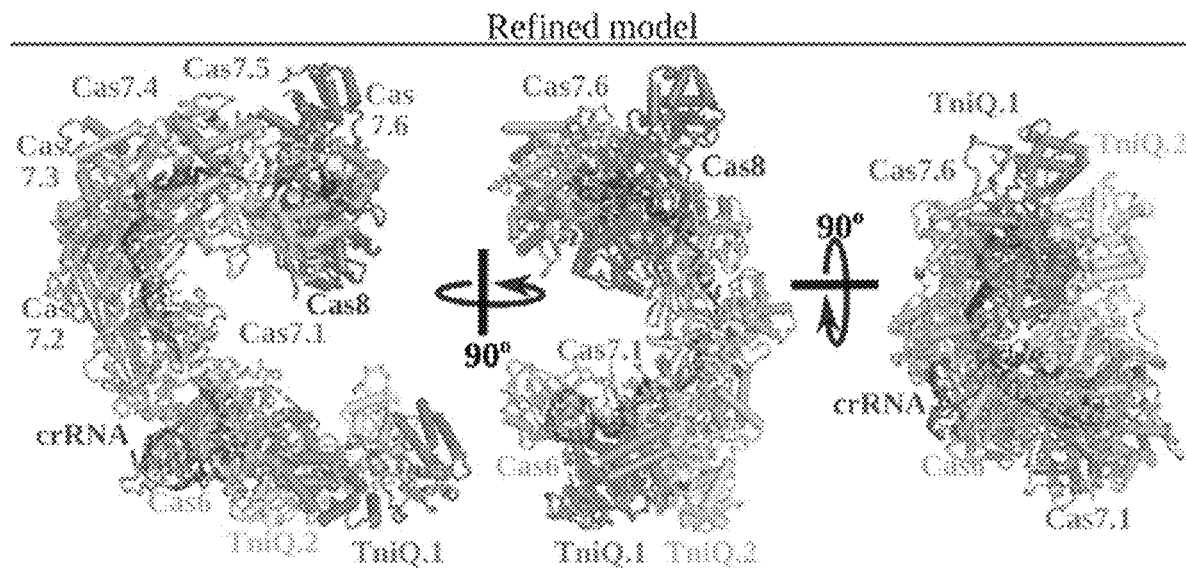
Figure 47A:
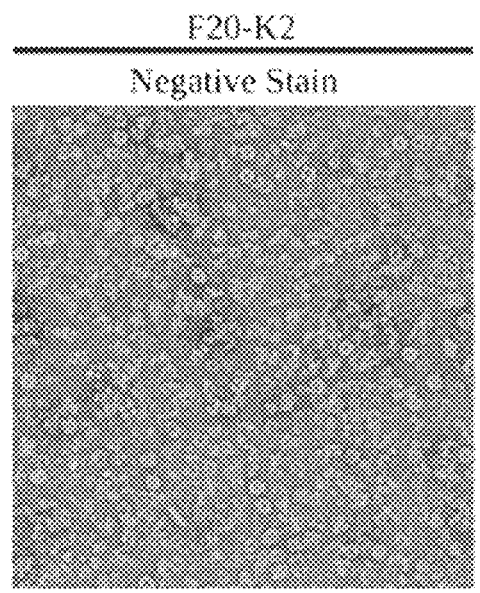
FIG. 47A-47D are the cryo-EM sample optimization and image processing workflow.
Figure 47B:
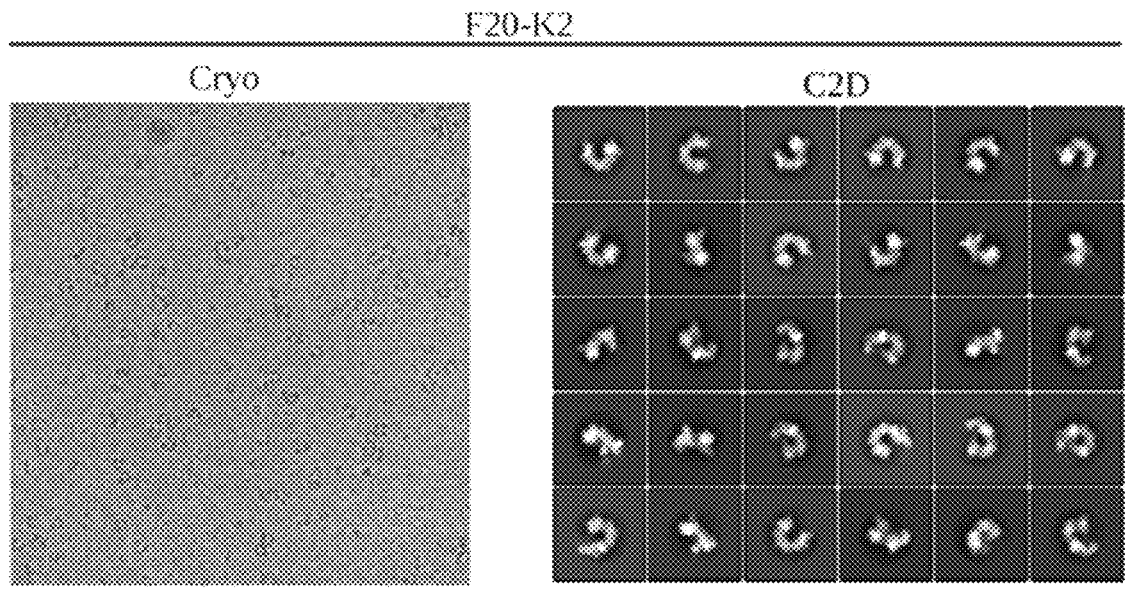
Figure 47C:
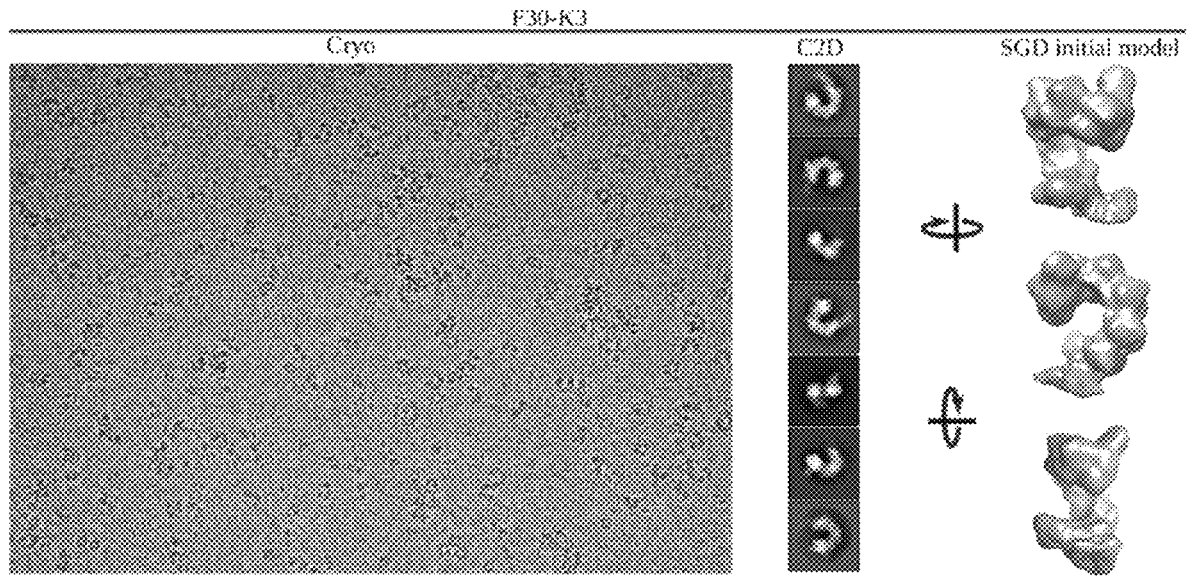
Figure 47D:
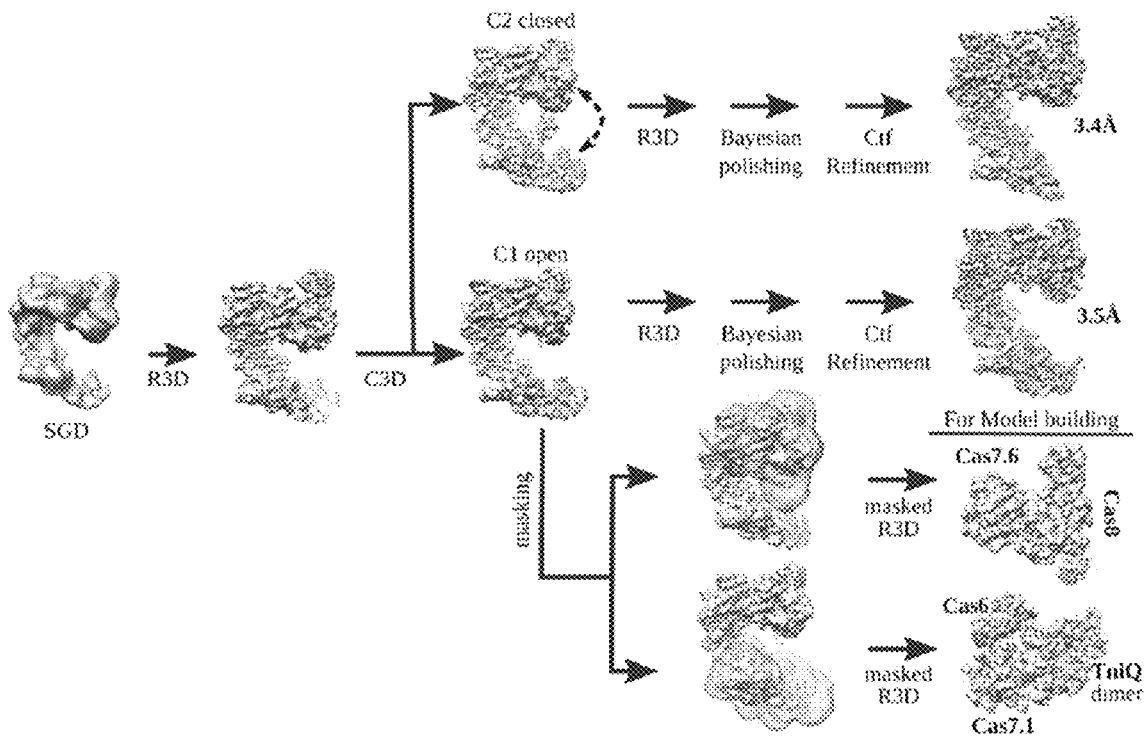
Figure 48A:
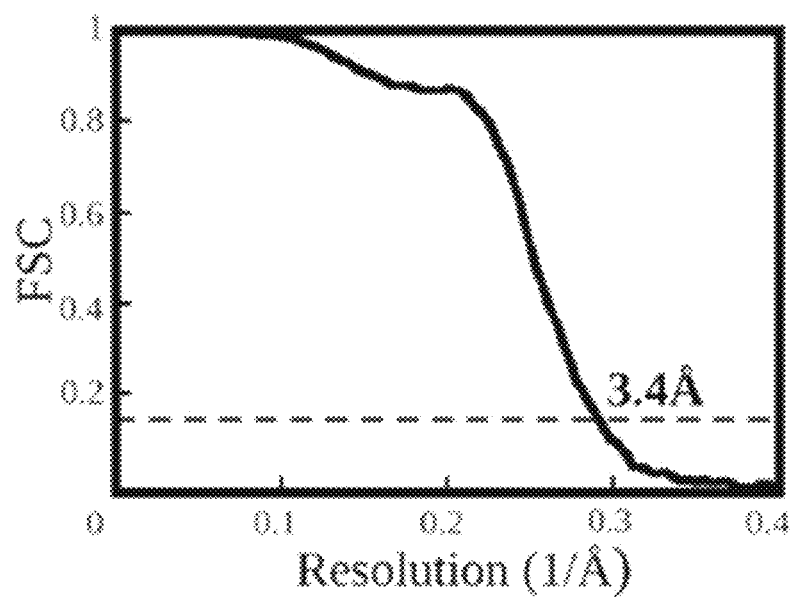
FIGS. 48A-48E are Fourier Shell Correlation (FSC) curves, local resolution, and unsharpened filter maps for the TniQ-Cascade complex in closed conformation.
Figure 48B:
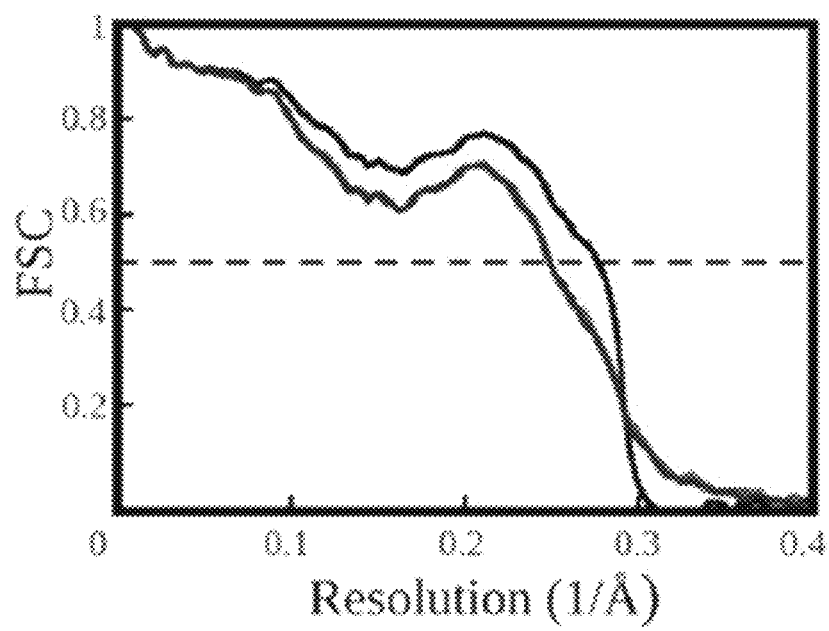
Figures 48C, 48D:
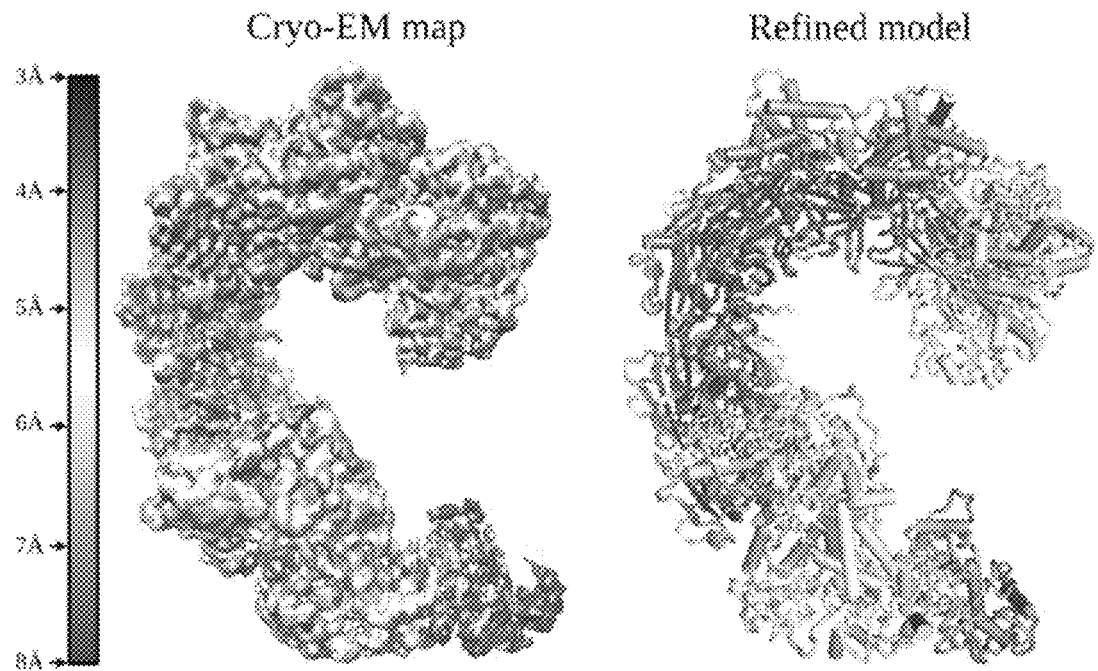
Figure 48E:
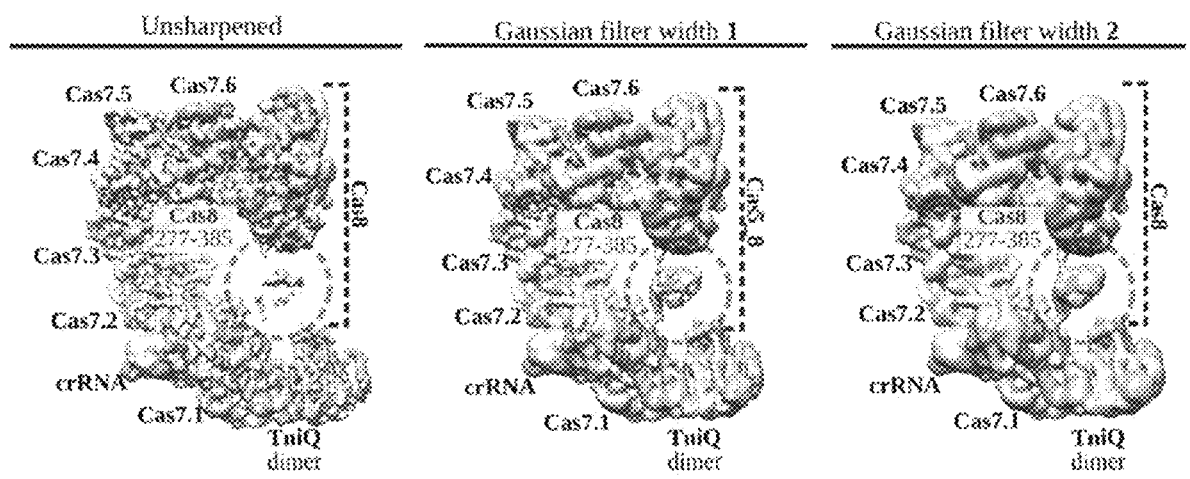
Figure 49:
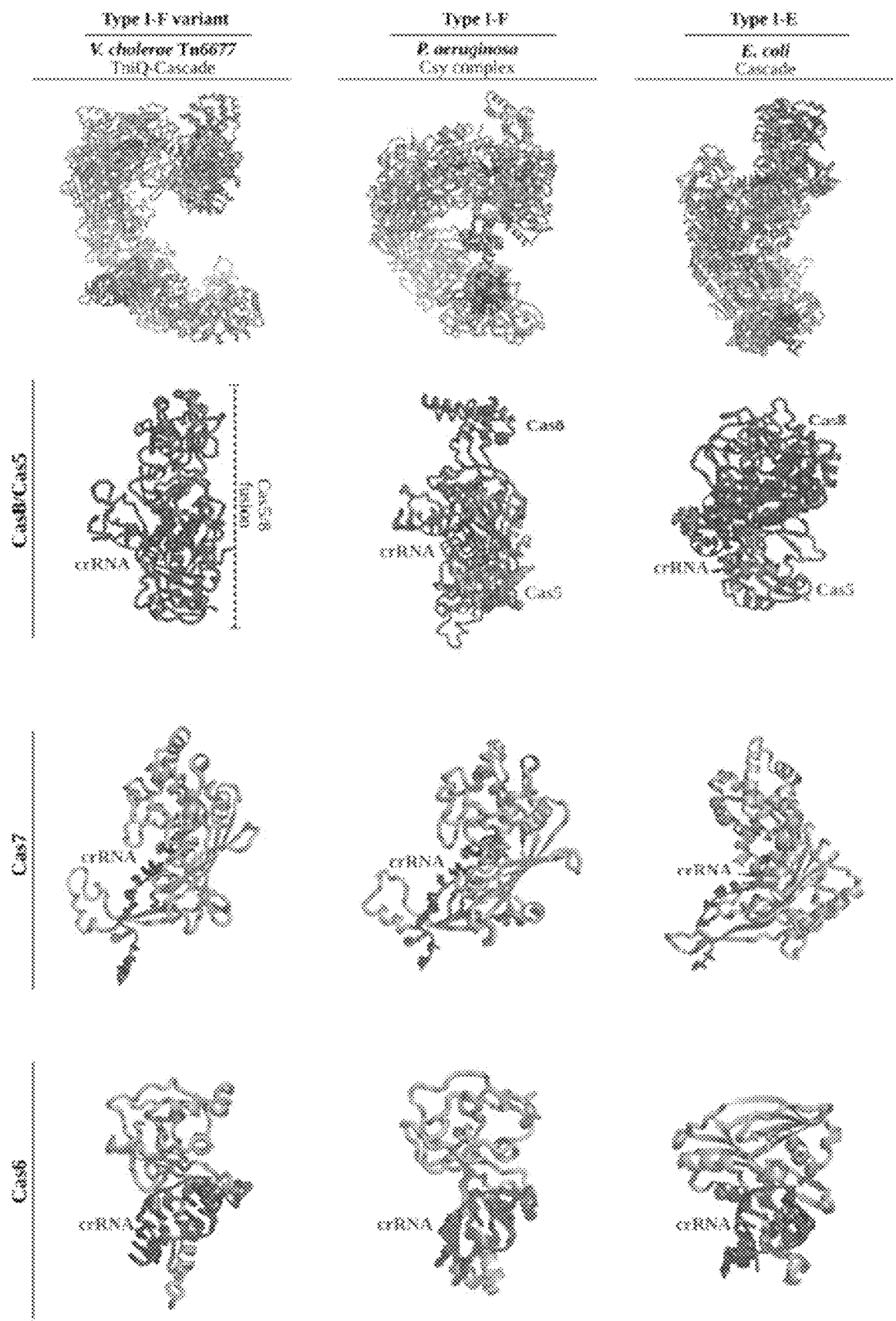
FIG. 49 is a superposition of TniQ-Cascade with structurally similar Cascade complexes. The *V. cholerae* I-F variant TniQ-Cascade complex (left) was superposed with *Pseudomonas aeruginosa* I-F Cascade$_{11}$ (also known as Csy complex; middle, PDB ID: 6B45) and *Escherichia coli* I-E Cascade$_9$ (right, PDB ID: 4TVX). Shown are superpositions of the entire complex (top), the Cas8 and Cas5 subunits with the 5' crRNA handle (middle top), the Cas7 subunit with a fragment of crRNA (middle bottom), and the Cas6 subunit with the 3' crRNA handle (bottom).

To determine this unambiguously, the *V. cholerae* TniQ-Cascade complex loaded with a native crRNA was purified and its structure was determined by cryo-EM. The overall complex adopted a helical architecture with protuberances at both ends (FIGS. 43, 47 and 48). The global architecture is similar to previously determined structures of Cascade from I-E and I-F systems (FIG. 49), with the exception of a large mass of additional density attributable to TniQ (see below). Maximum likelihood classification methods implemented in Relion3 allowed identification of significant dynamics in the entire complex, which appears to "breathe", widening and narrowing the distance between the two protuberances (FIG. 47D). The large subunit encoded by a natural Cas8-Cas5 fusion protein (hereafter in this Example referred to simply as Cas8) formed one protuberance and recognized the 5' end of the crRNA via base- and backbone-specific contacts (FIGS. 50, 51A-C, 52A), akin to the canonical roles played by Cas8 and Cas5 (FIG. 49). Cas8 exhibited two primary subdomains formed mainly by α-helices, along with a third domain of approximately 100 residues (residues 277 to 385) that was predicted to form three α-helices but could not be built in the maps due to its intrinsic flexibility (FIG. 43C). However, low pass filtered maps revealed that this flexible domain connected with the TniQ protuberance at the opposite end of the crescent-shaped complex (FIG. 48E). Additionally, there appeared to be a loose coupling between the Cas8 flexible domain and overall "breathing" of the complex, as stronger density for that domain was observed in the closed state (FIG. 47D).

Figure 50A:
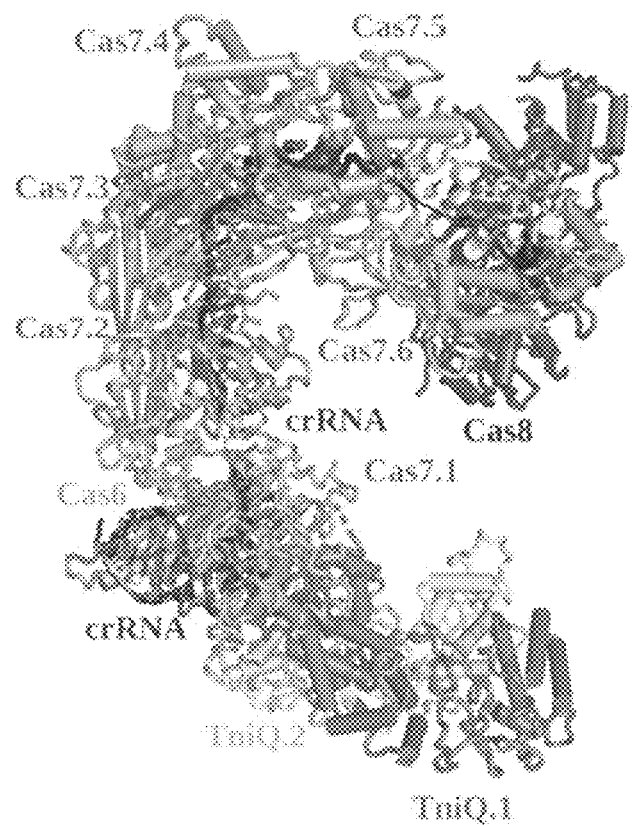
FIGS. 50A-H are representative cryo-EM densities for all the components of the TniQ-Cascade complex in closed conformation.
Figures 50B, 50C:
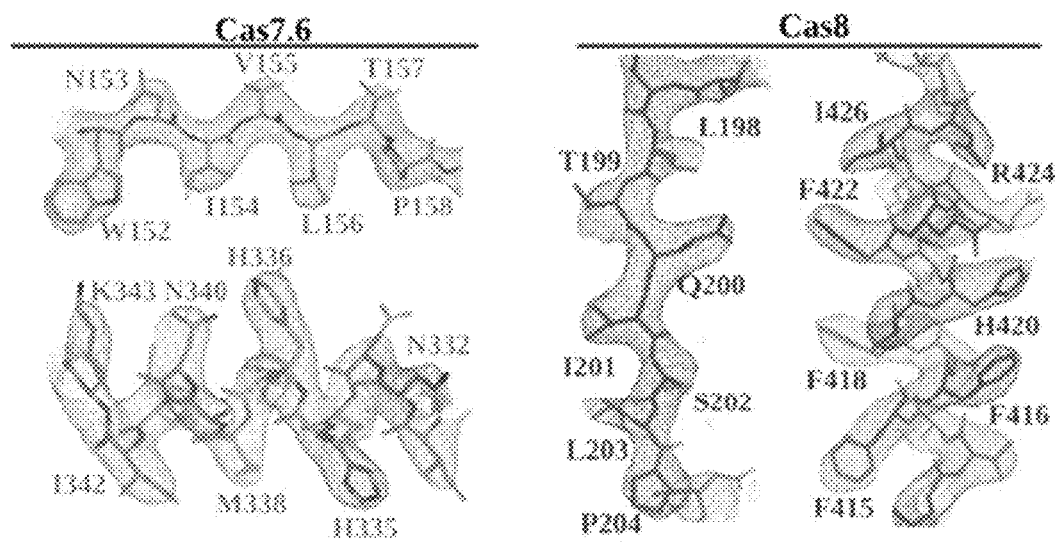
Figure 50D:
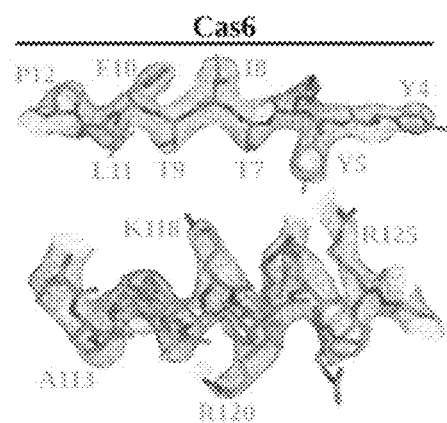
Figure 50E:
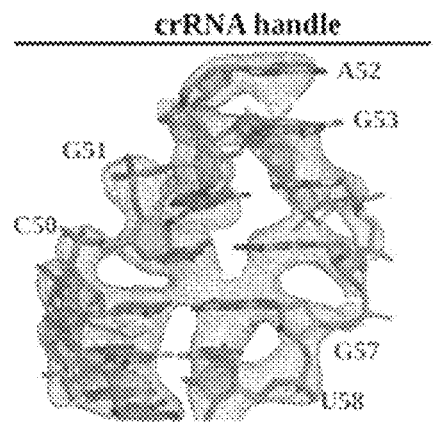
Figure 50F:
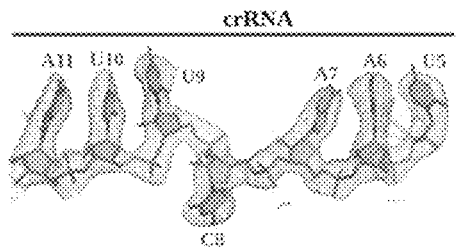
Figure 50G:
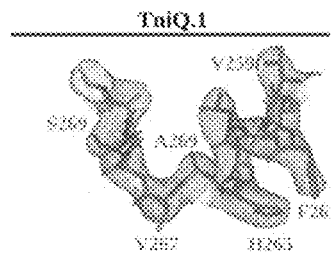
Figure 50H:
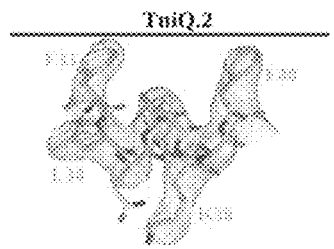
Figure 51:
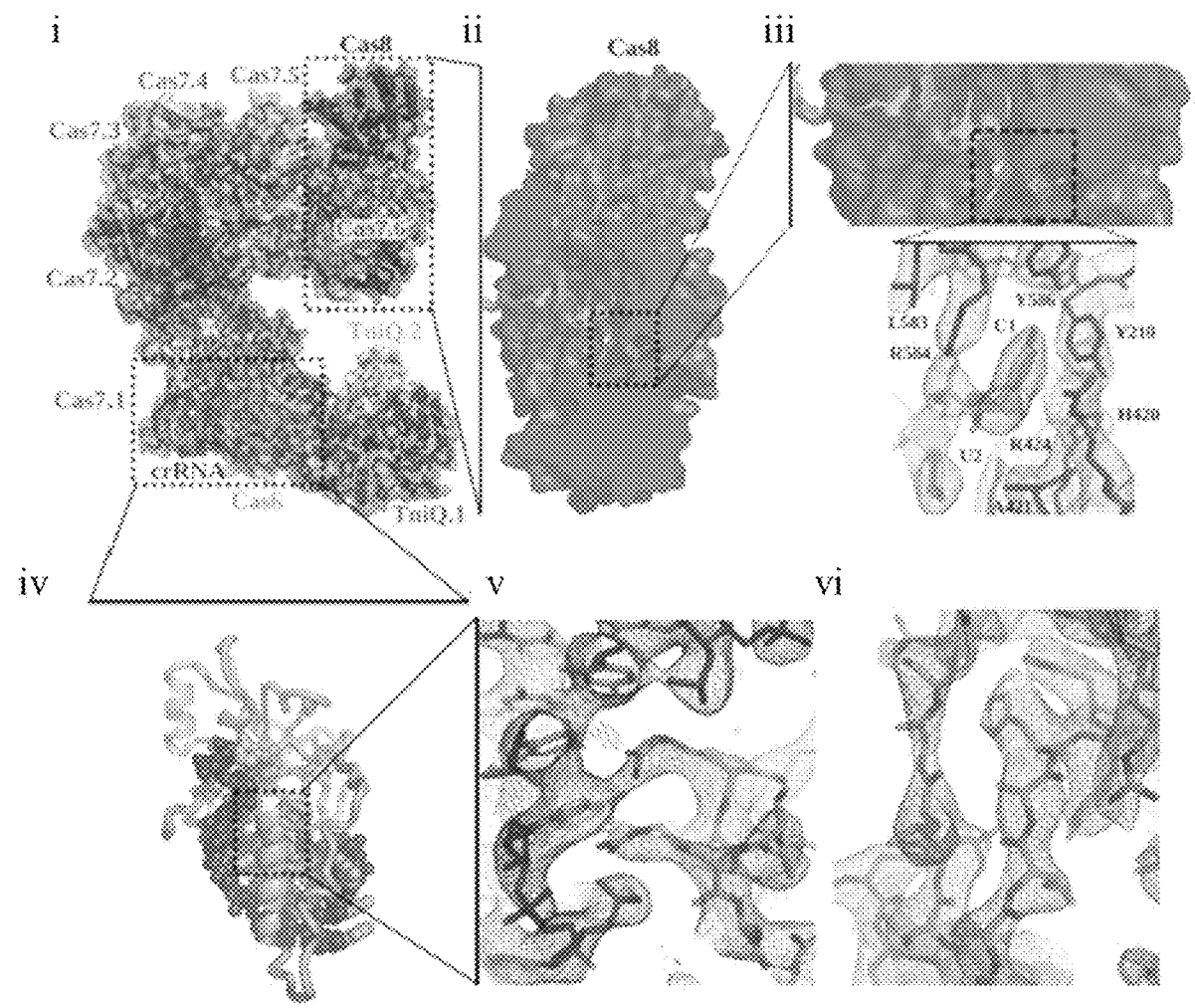
FIG. 51 shows the Cas8 and Cas6 interaction with the crRNA. i) is a refined model for the TniQ-Cascade shown as ribbons inserted in the semitransparent Van der Waals surface, colored as in FIG. 1. ii) and iii) are zoomed views of Cas8, which interacts with the 5' end of the crRNA. The inset shows electron density for the highlighted region, where the base of nucleotide C1 is stabilized by stacking interactions with arginine residues R584 and R424. iv) shows Cas6 interacting with the 3' end of the crRNA "handle" (nucleotides 45-60). v) is an arginine-rich α-helix is deeply inserted within the major groove of the terminal stem-loop. This interaction is mediated by electrostatic interactions between basic residues of Cas6 and the negatively charged phosphate backbone of the crRNA. vi) shows Cas6 (red) also interacting with Cas7.1 (green), establishing a β-sheet formed by β-strands contributed from both proteins.

Six Cas7 subunits protected much of the crRNA by forming a helical filament along its length (FIGS. 43B and 43D), similar to other Type I Cascade complexes (FIG. 49). A "finger" motif in Cas7 clamped the crRNA in regular intervals, causing every sixth nucleotide (nt) of the 32-57 nt spacer to flip out while leaving the flanking nucleotides available for DNA recognition (FIGS. 50F and 52). These bases were pre-ordered in short helical segments, with a conserved phenylalanine stacking below the first base of every segment. Cas7.1, the monomer furthest away from Cas8, interacted with Cas6 (also known as Csy4), which is the ribonuclease responsible for processing of the precursor RNA transcript derived from the CRISPR locus. The Cas6-Cas7.1 interaction was mediated by a β-sheet formed by the contribution of a β-strands from Cas6 and the two β-strands that form the finger of Cas7.1 (FIG. 51(vi)). Cas6 also formed extensive interactions with the conserved stem-loop in the repeat-derived 3' crRNA handle (FIGS. 43 and 51(iv and v)), with an arginine-rich α-helix (residues 110 to 128) docked in the major groove, positioning multiple basic residues within interaction distance of the negatively charged RNA backbone.

The interaction established between Cas6 and Cas7.1 formed a continuous surface where TniQ was docked, forming the other protuberance of the crescent. The intrinsic flexibility of the complex rendered lower local resolutions in this area of the maps, which was overcome using local alignments masking the area comprising TniQ, Cas6, Cas7.1 and the crRNA handle (FIG. 53). The enhanced maps allowed for de novo modeling and refinement of TniQ, for which no previous structure or homology model has been reported (FIG. 44). Notably, TniQ binds to Cascade as a dimer with head-to-tail configuration (FIG. 44), a surprising result given the expectation that EcoTnsD functions as a monomer during Tn7 transposition.

Figure 44A:
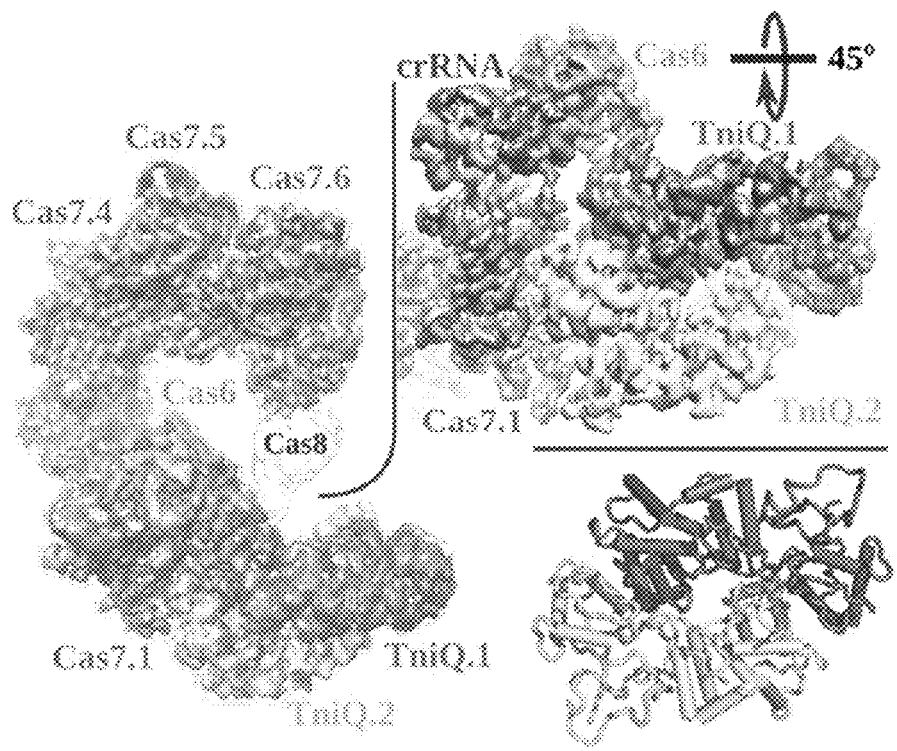
FIGS. 44A-44D show that TniQ binds Cascade in a dimeric, head-to-tail configuration.
Figure 44B:
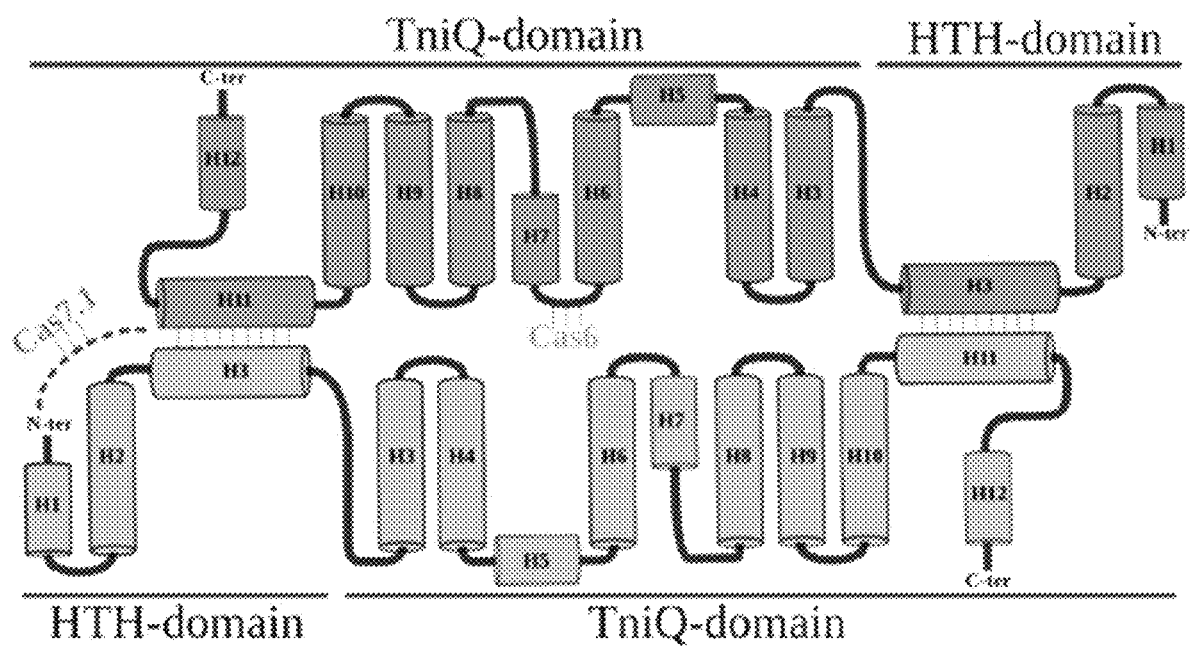
Figure 44C:
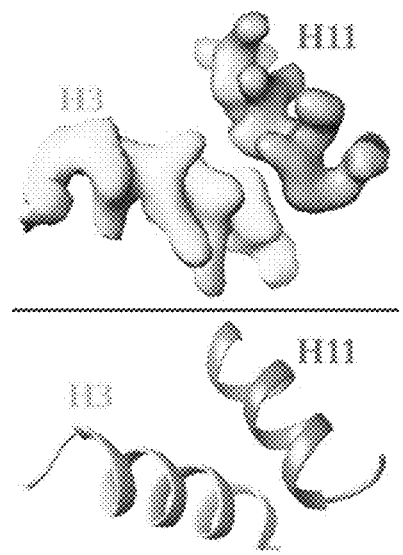
Figure 44D:
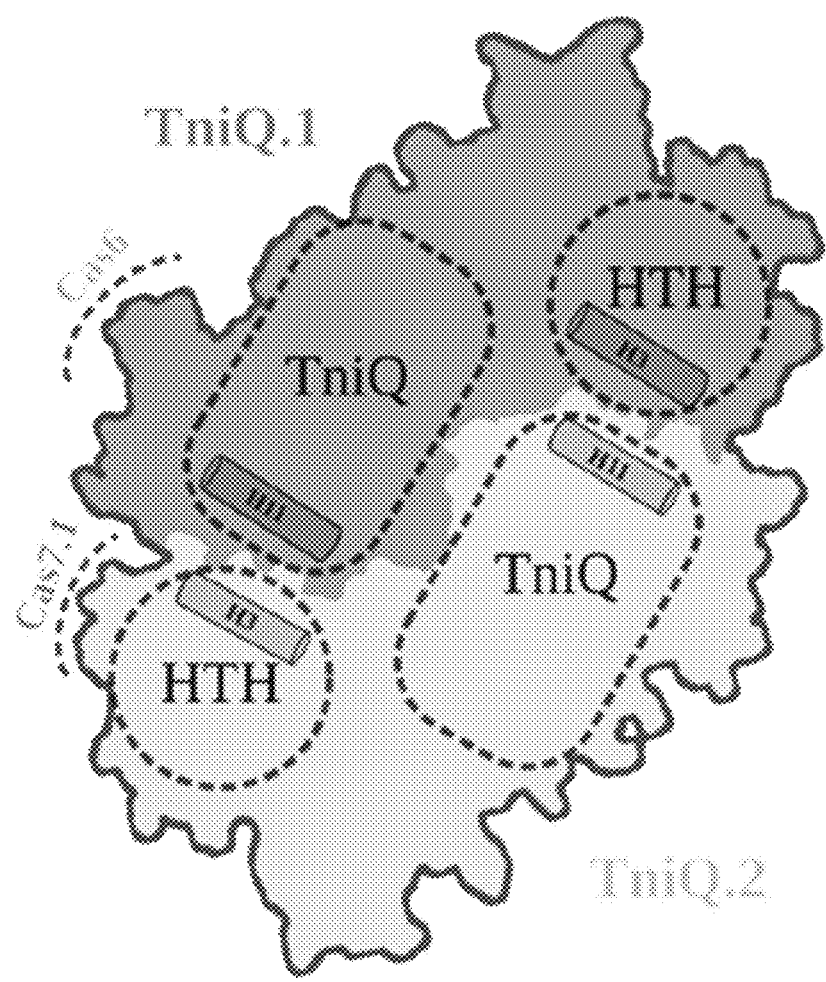
Figure 45A:
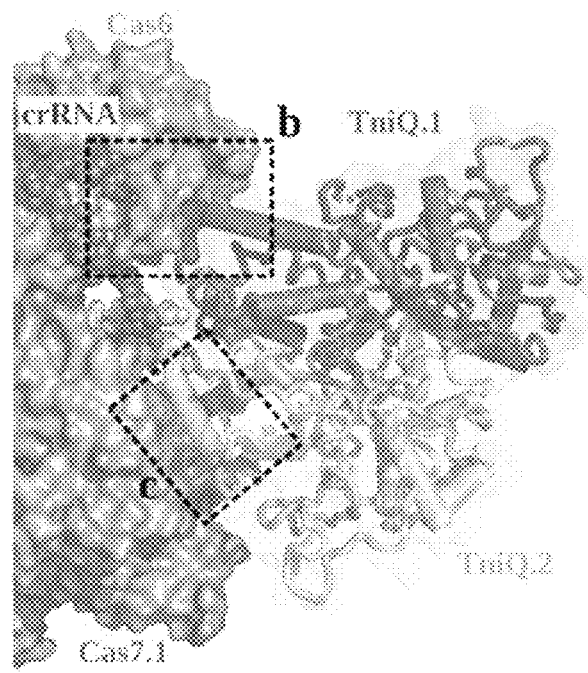
FIG. 45A-45E show that Cas6 and Cas7.1 form a binding platform for TniQ.
Figure 45B:
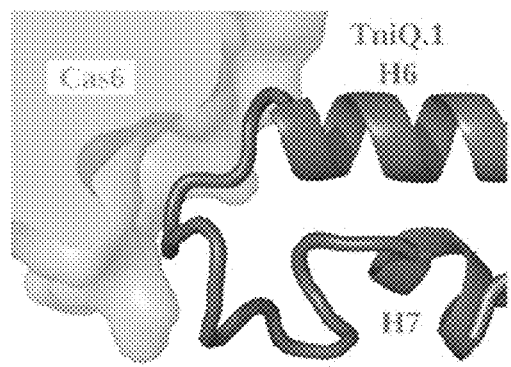
Figure 45C:
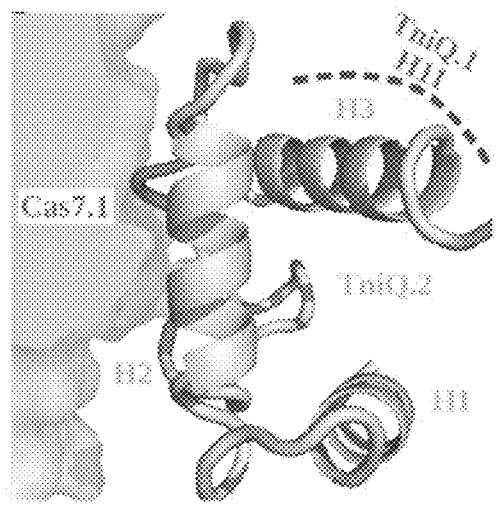
Figure 45D:
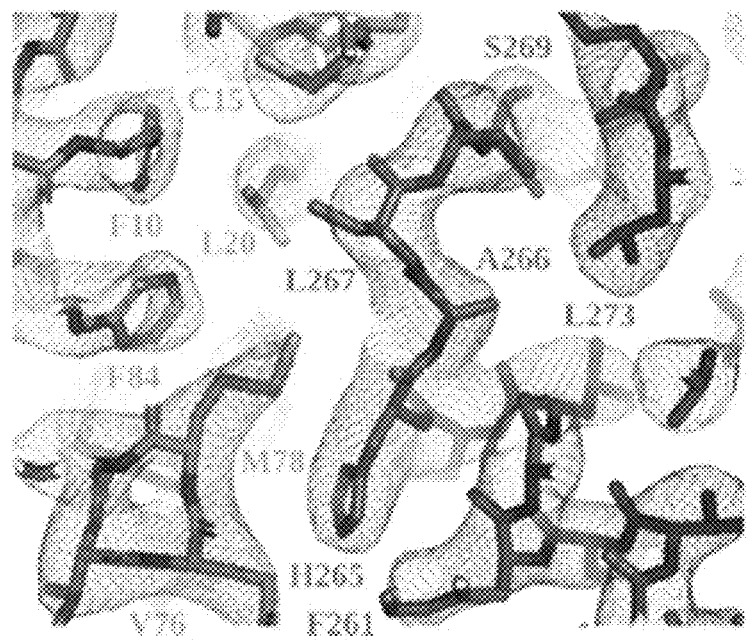
Figure 45E:
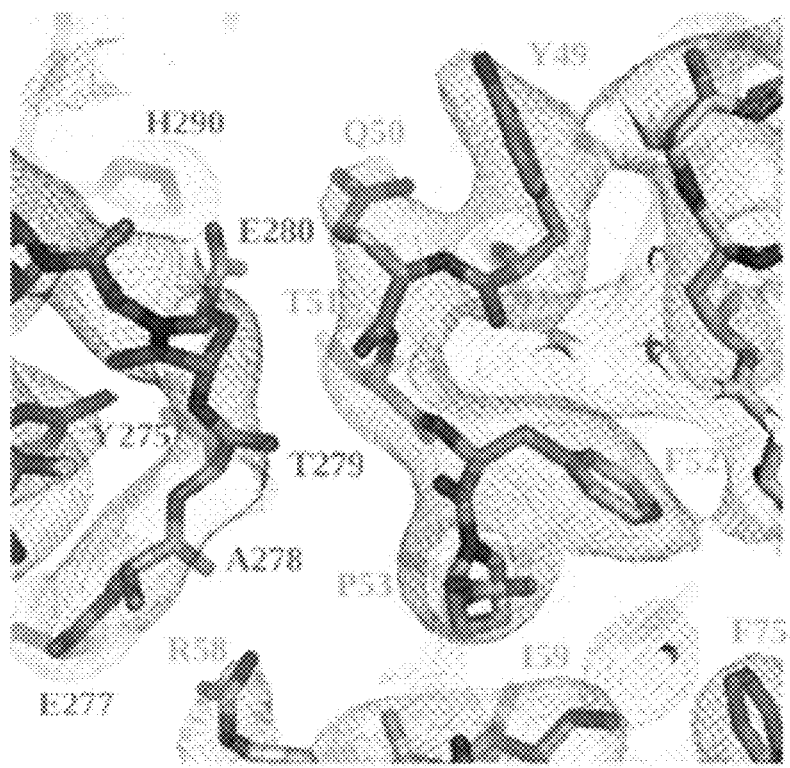
Figures 54A, 54B, 54C:
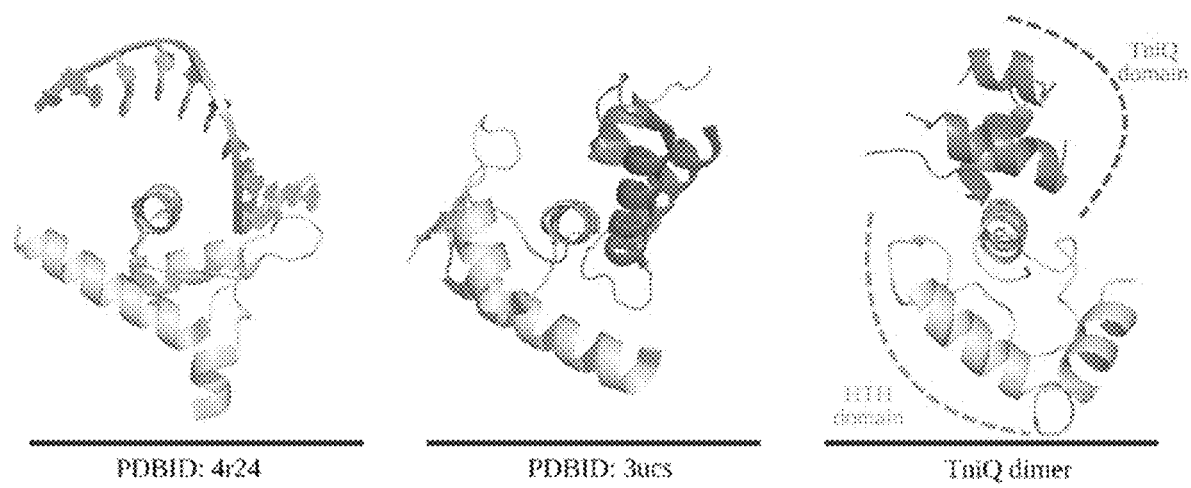
FIGS. 54A-54C shows that TniQ harbors a HTH domain involved in protein-protein interactions within the TniQ dimer. A DALI search using the refined TniQ model as probe found significant similarity between the N-terminal domain of TniQ with PDB entries 4r24 (FIG. 54A) and 3ucs (FIG. 54B) (Z score 4.1/4.1, r.m.s.d. 3.8/5.1). Both proteins contain Helix-Turn-Helix (HTH) domains and HTH domains are often involved in nucleic acid recognition and mediate protein-protein interactions.

TniQ was composed of two domains: an N-terminal domain of approximately 100 residues formed by three short α-helices and a second, larger domain of approximately 300 residues with signature sequence for the TniQ family. A DALI search using the refined TniQ model as a probe yielded significant structural similarity of the N-terminal domain to proteins containing Helix-Turn-Helix (HTH) domains (FIG. 54). This domain is often involved in nucleic acid recognition, however there are reported examples where it has been re-purposed for protein-protein interactions. The remaining C-terminal TniQ-domain was formed by 10 α-helices of variable length and was predicted to contain two tandem zinc finger motifs, though this region was poorly defined in the maps (FIG. 44). Overall, the double domain composition of TniQ resulted in an elongated structure, bent at the junction of the HTH and the TniQ-domain (FIG. 44). The HTH domain of one monomer engages the TniQ-domain of the other monomer via interactions between α-helix 3 (H3) and α-helix 11 (H11), respectively, in a tight protein-protein interaction (FIG. 44C). This reciprocal interaction was complemented by multiple interactions established between the TniQ-domains from both monomers (up to 45 non-covalent interactions as reported by PISA).

Tethering of the TniQ dimer to Cascade was accomplished by specific interactions established with both Cas6 and Cas7.1 (FIG. 45). One monomer of TniQ interacted with Cas6 via its C-terminal TniQ-domain, while the other TniQ monomer contacted Cas7.1 through its N-terminal HTH domain (FIGS. 44B and 45). The loop connecting α-helices H6 and H7 of the TniQ-domain of the first TniQ monomer was inserted in a hydrophobic cavity formed at the interface of two α-helices of Cas6 (FIGS. 45B and 45D). The TniQ histidine residue 265 was involved in rearranging the hydrophobic loop connecting H6 and H7 (FIG. 45D), which was inserted in the hydrophobic pocket of Cas6 formed by residues L20, Y74, M78, Y83 and F84. The HTH domain of the other TniQ monomer interacted with Cas7.1 through a network of interactions established mainly by α-helix H2 and the linker connecting H2 and H3 (FIGS. 45C and 45E). Thus, both the HTH domain and the TniQ-domain appeared to exert dual roles to drive TniQ dimerization and dock onto Cascade.

Figure 55A:
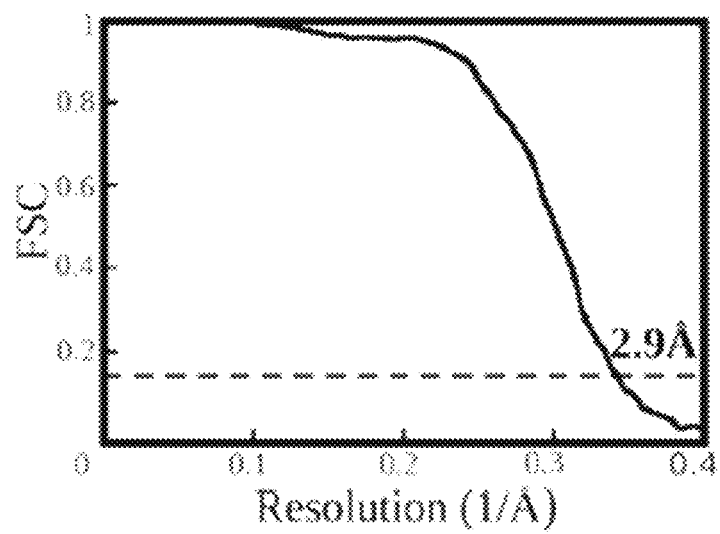
FIGS. 55A-55C are the Fourier Shell Correlation (FSC) curves, local resolution, and unsharpened filter maps for the DNA-bound TniQ-Cascade complex.
Figure 55B:
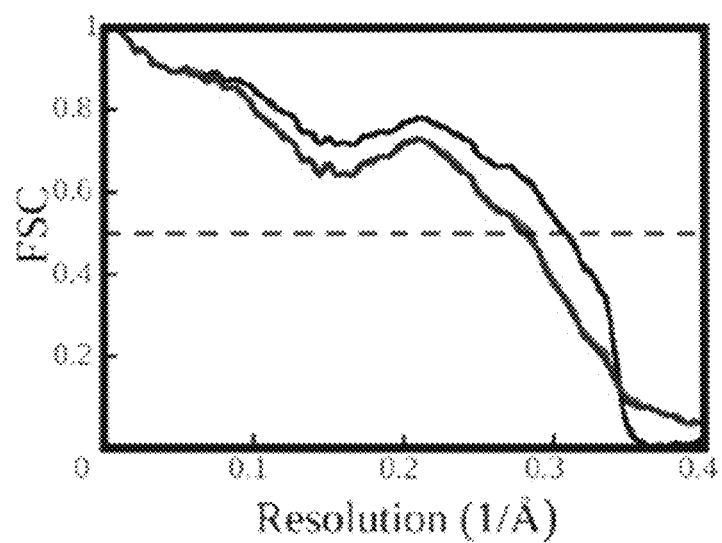
Figure 55C:
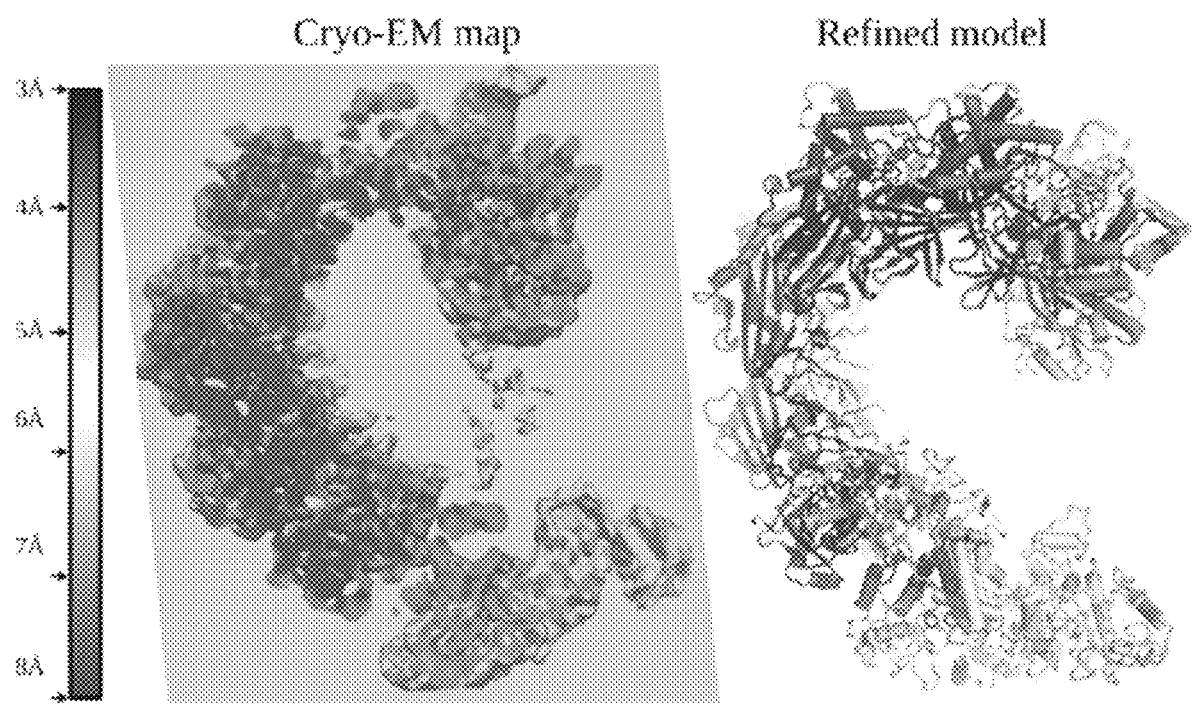
Figure 56:
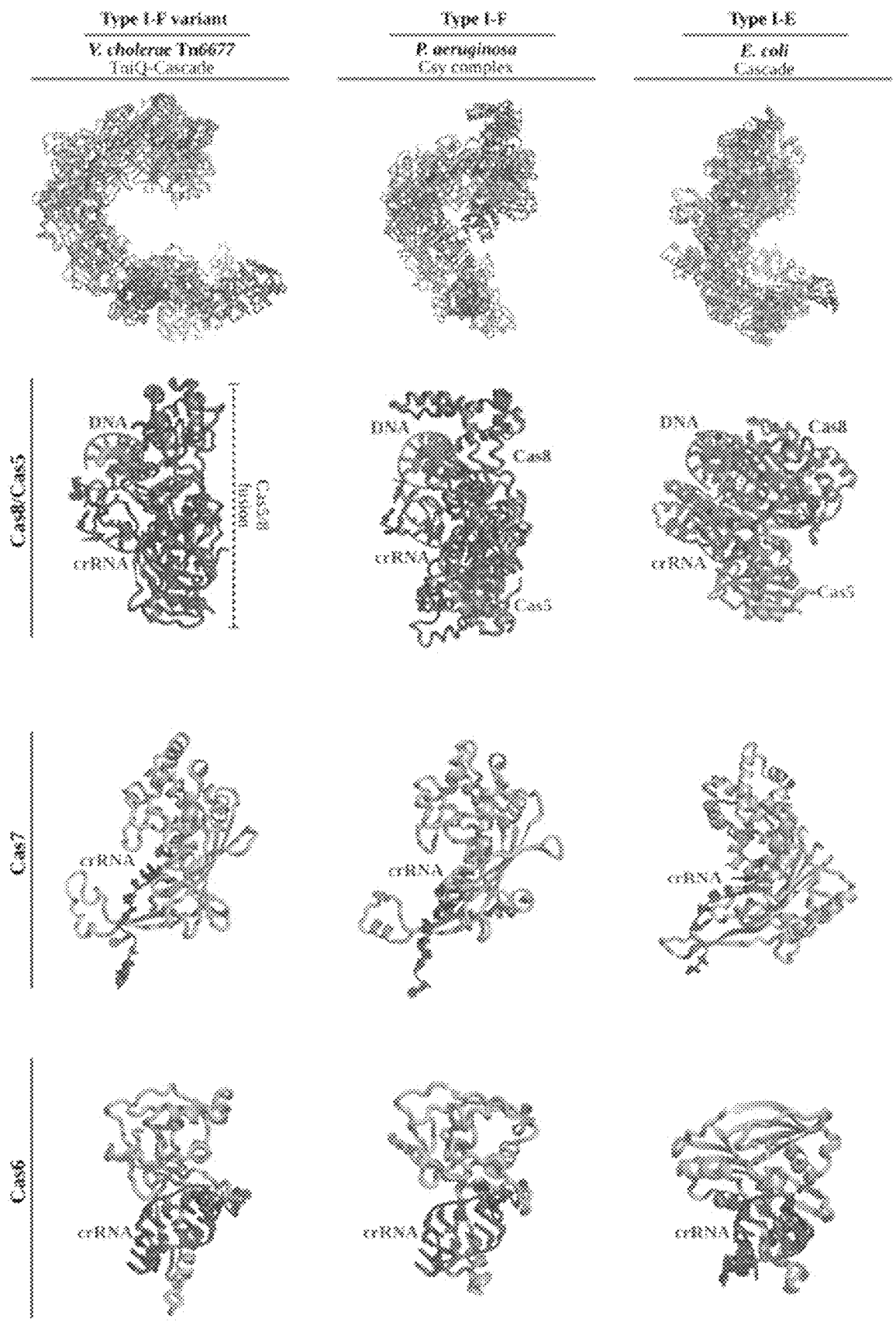
FIG. 56 is the superposition of DNA-bound TniQ-Cascade with structurally similar Cascade complexes. The DNA-bound structure of *V. cholerae* I-F variant TniQ-Cascade complex (left) was superposed with DNA-bound structures of *Pseudomonas aeruginosa* I-F Cascade$_{11}$ (also known as Csy complex; middle, PDB ID: 6B44) and *Escherichia coli* I-E Cascade$_9$ (right, PDB ID: 5H9F). Shown are superpositions of the entire complex (top), the Cas8 and Cas5 subunits with the 5' crRNA handle and double-stranded PAM DNA (middle top), the Cas7 subunit with a fragment of crRNA (middle bottom), and the Cas6 subunit with the 3' crRNA handle (bottom).
Figure 59:
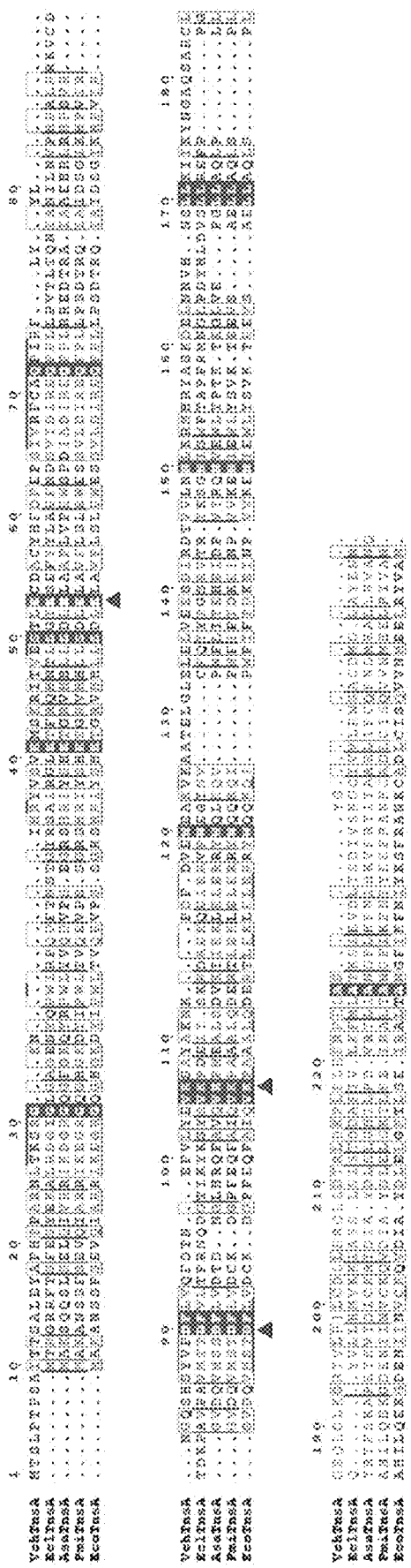
FIG. 59 is a multiple sequence alignment of TnsA from Vch, *Vibrio cholerae* (SEQ ID NO: 141); Ecl, *Enterobacter cloacae* (SEQ ID NO: 1715); Asa, *Aeromonas salmonicida* (SEQ ID NO: 716); Pmi, *Proteus mirabilis* (SEQ ID NO: 1717); Eco, *Escherichia coli* (SEQ ID NO: 1714). Conserved catalytic residues are indicated with red triangles.
Figure 60:
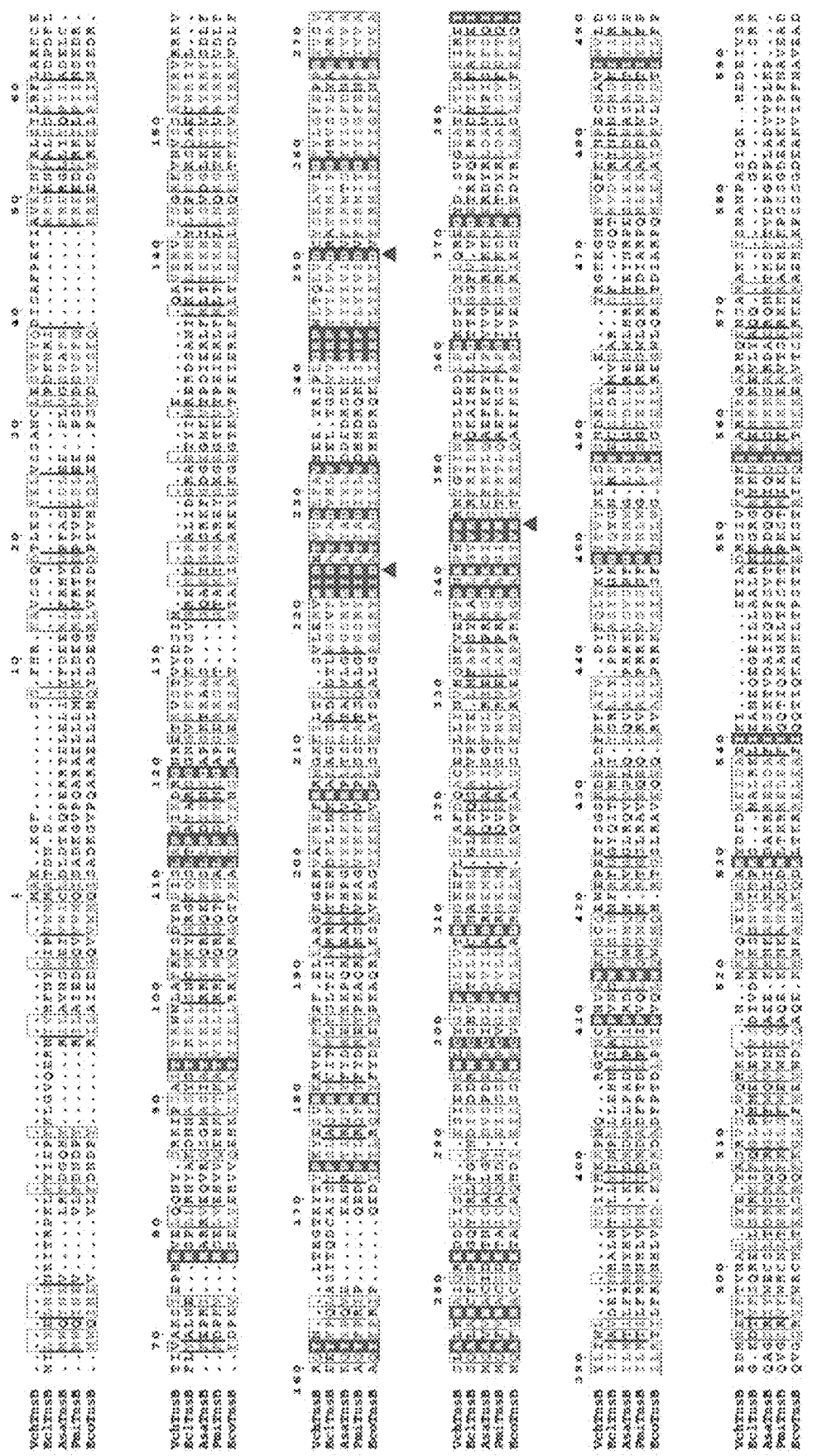
FIG. 60 is a multiple sequence alignment of TnsB from Vch, *Vibrio cholerae* (SEQ ID NO: 143); Ecl, *Enterobacter cloacae* (SEQ ID NO: 1719); Asa, *Aeromonas salmonicida* (SEQ ID NO: 1720); Pmi, *Proteus mirabilis* (SEQ ID NO: 1721); Eco, *Escherichia coli* (SEQ ID NO: 1718). Conserved catalytic residues are indicated with red triangles.
Figure 61:
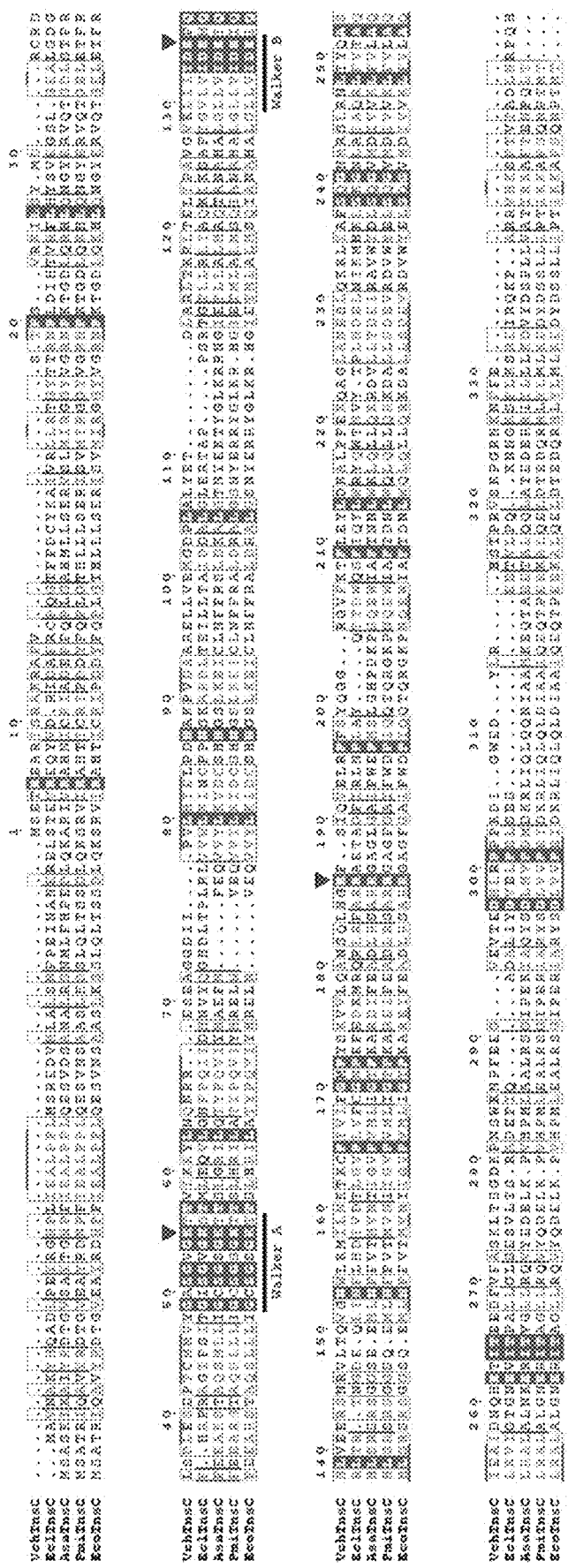
FIG. 61 is a multiple sequence alignment of TnsC from Vch, *Vibrio cholerae* (SEQ ID NO: 145); Ecl, *Enterobacter cloacae* (SEQ ID NO: 1723); Asa, *Aeromonas salmonicida* (SEQ ID NO: 1724); Pmi, *Proteus mirabilis* (SEQ ID NO: 1725); Eco, *Escherichia coli* (SEQ ID NO: 1722). Walker A and Walker B motifs characteristic of AAA+ ATPases are indicated, and active site residues involved in ATPase activity are indicated with blue triangles. Some TnsC homologs are annotated as TniB.
Figure 64:
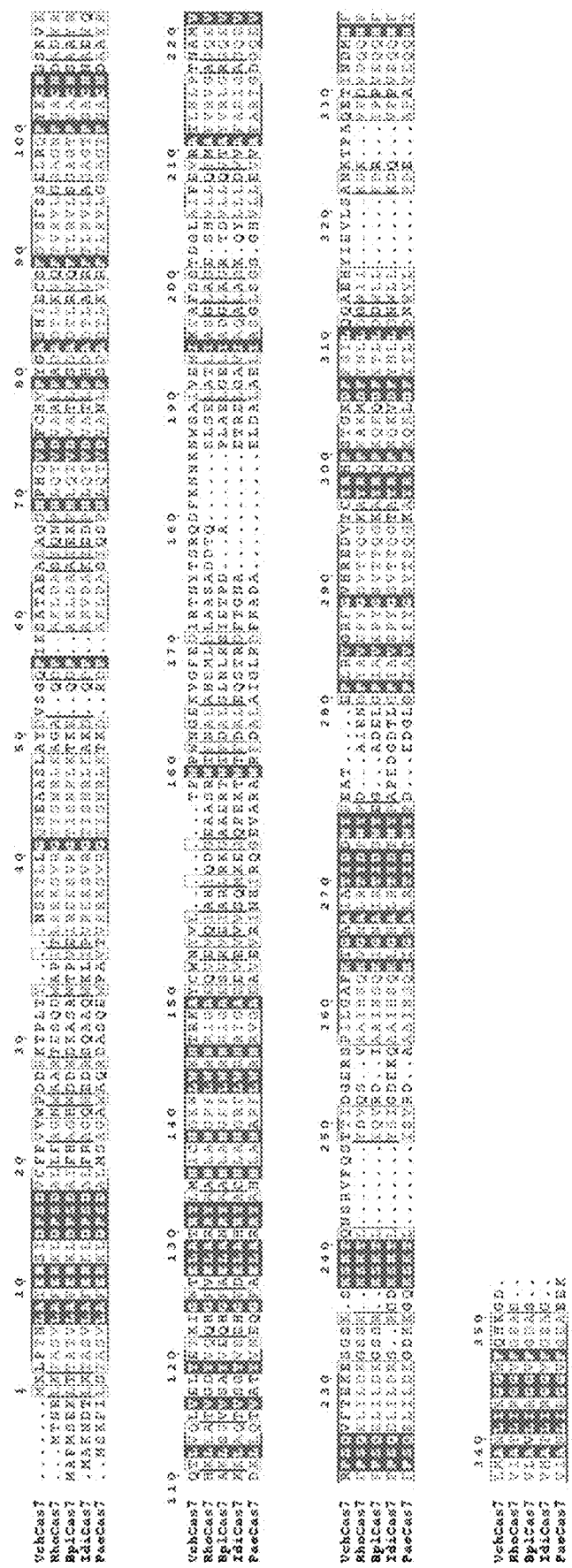
FIG. 64 Multiple sequence alignment of Cas7 from Vch (SEQ ID NO: 151), *Vibrio cholerae*; Rho, *Rhodanobacter* sp (SEQ ID NO: 1734); Bpl, *Burkholderia plantarii* (SEQ ID NO: 1735); Idi, *Idiomarina* sp. H105 (SEQ ID NO: 1736); Pae, *Pseudomonas aeruginosa* (SEQ ID NO: 1737). VchCas7 is aligned to other I-F Cas7 proteins, which are often annotated as Csy3.
Figure 65A:
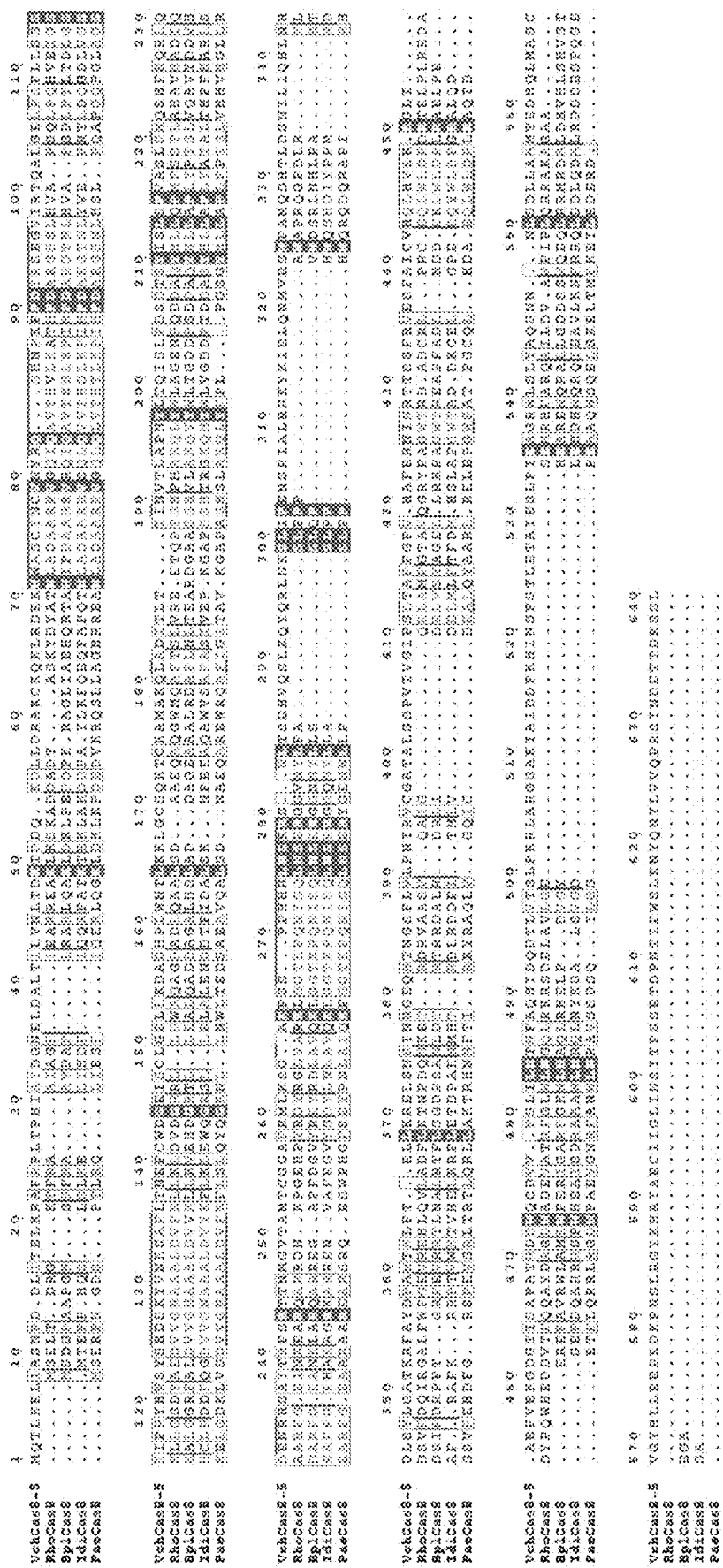
FIGS. 65A and 65B are multiple sequence alignments of Cas8 and Cas5 from Vch, *Vibrio cholerae* (SEQ ID NO: 149); Rho, *Rhodanobacter* sp (SEQ ID NOs: 1738 and 1742, respectively); Bpl, *Burkholderia plantarii* (SEQ ID NOs: 1739 and 1743, respectively); Idi, *Idiomarina* sp. H105 (SEQ ID NOs: 1740 and 1744, respectively); Pae, *Pseudomonas aeruginosa* (SEQ ID NOs: 1741 and 1745, respectively). VchCas8, a natural Cas8-Cas5 fusion protein, is aligned to other I-F Cas8 proteins (FIG. 65A), which are often annotated as Csy1, and to other I-F Cas5 proteins (FIG. 65B), which are often annotated as Csy2.
Figure 65B:
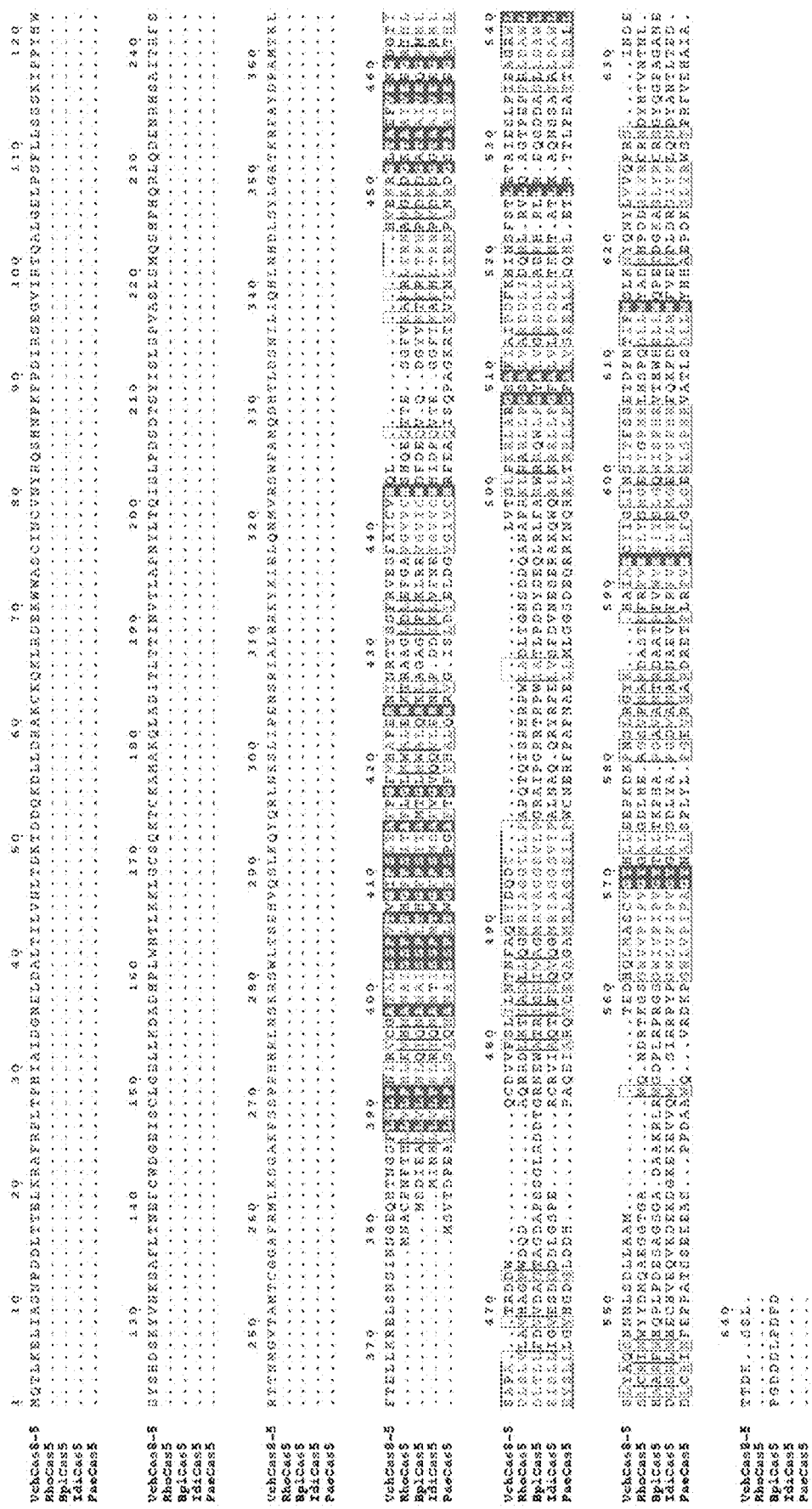

In order to explore the structural determinants of DNA recognition by the TniQ-Cascade complex, the structure of the complex bound to a double-stranded DNA (dsDNA) substrate containing the 32-bp target sequence, 5'-CC-3' PAM, and 20-bp of flanking dsDNA on both ends was determined (FIGS. 46 and 55). Density for 28 nucleotides of the target strand (TS) and 8 nucleotides for the non-target strand (NTS) could be confidently assigned in the reconstructed maps (FIG. 46C). As with previous I-F Cascade structures, Cas8 recognized the double stranded PAM within the minor groove (FIG. 56), and an arginine residue (R246) established a stacking interaction with a guanine nucleotide on the TS, which acted like a wedge to separate the double-stranded PAM from the neighboring unwound DNA where base-pairing with the crRNA begins (FIG. 46B).

Figure 52A:
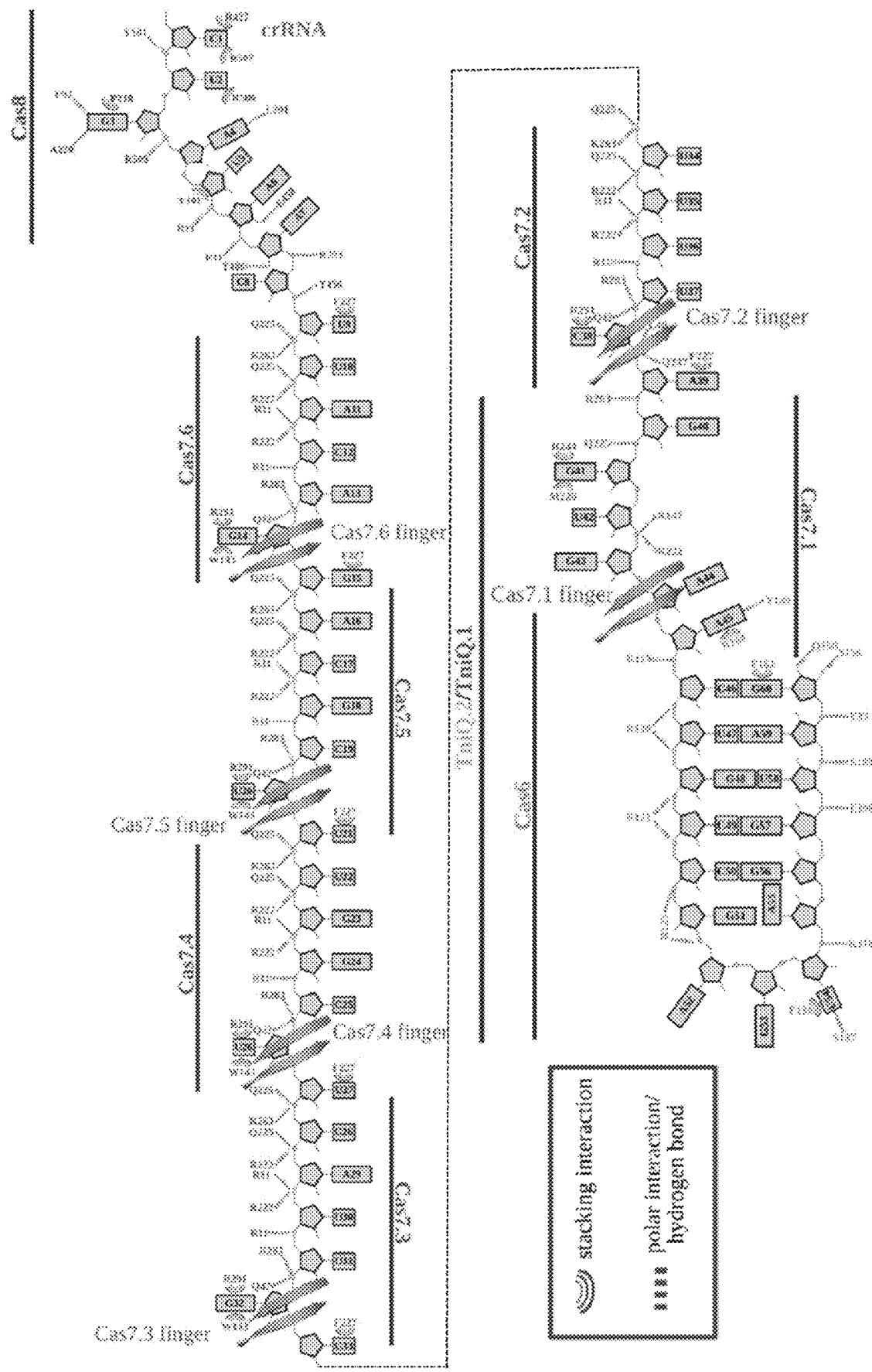
FIGS. 52A-52B are schematic representations of crRNA and target DNA recognition by TniQ-Cascade.
Figure 52B:
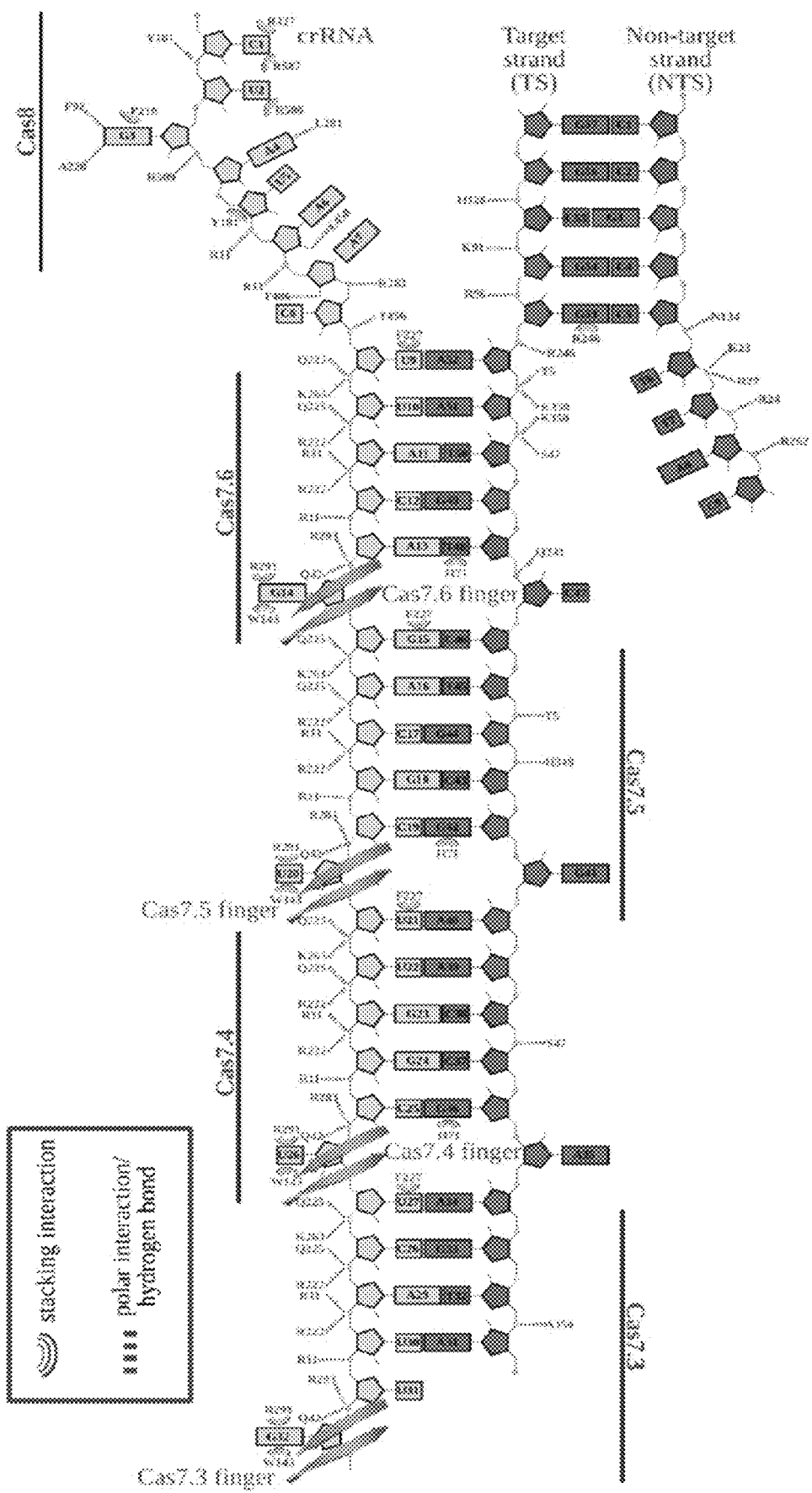
Figure 53A:
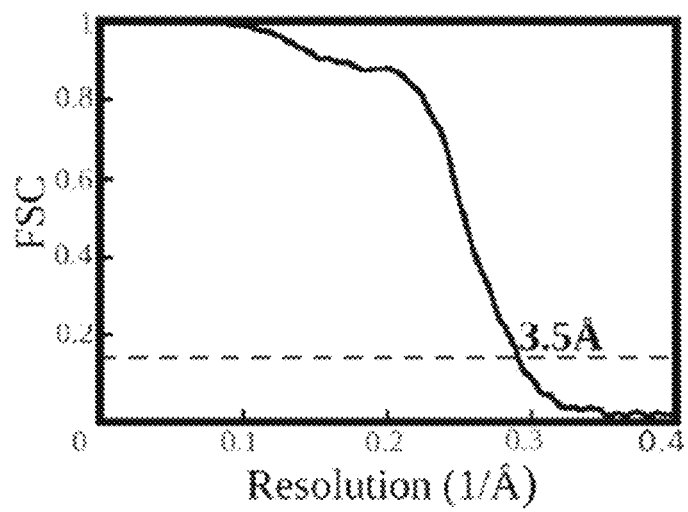
FIGS. 53A-53E are Fourier Shell Correlation (FSC) curves, local resolution, and local refined maps for the TniQ-Cascade complex in open conformation.
Figure 53B:
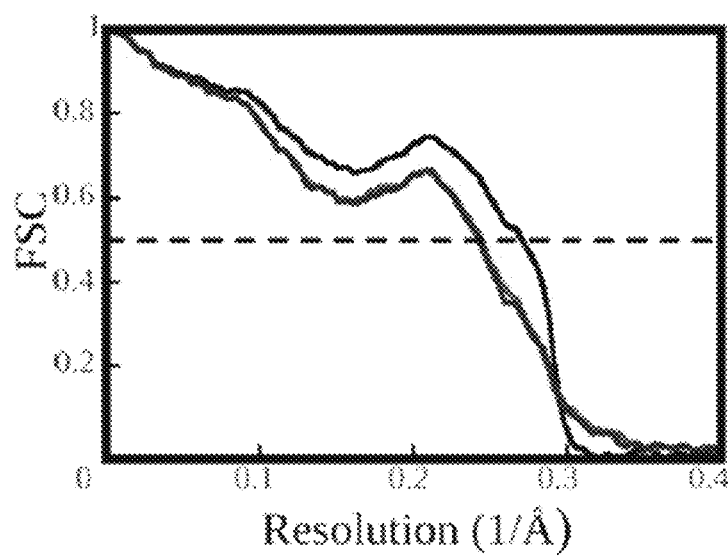
Figure 53C:
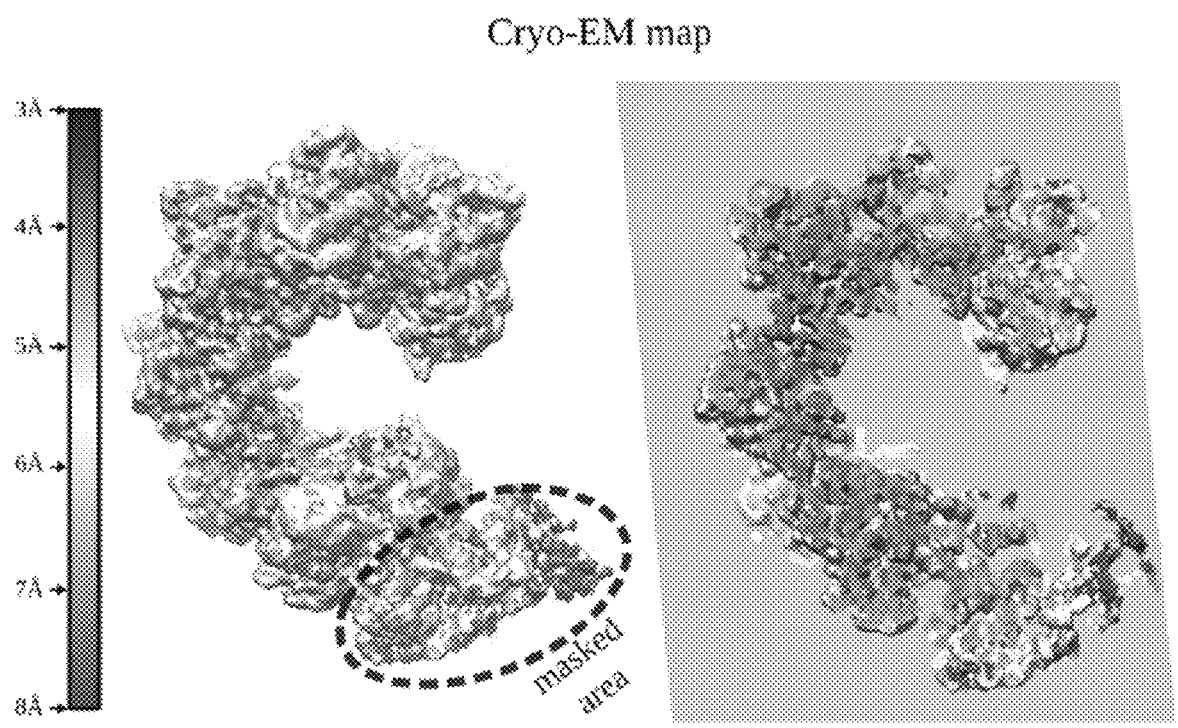
Figure 53D:
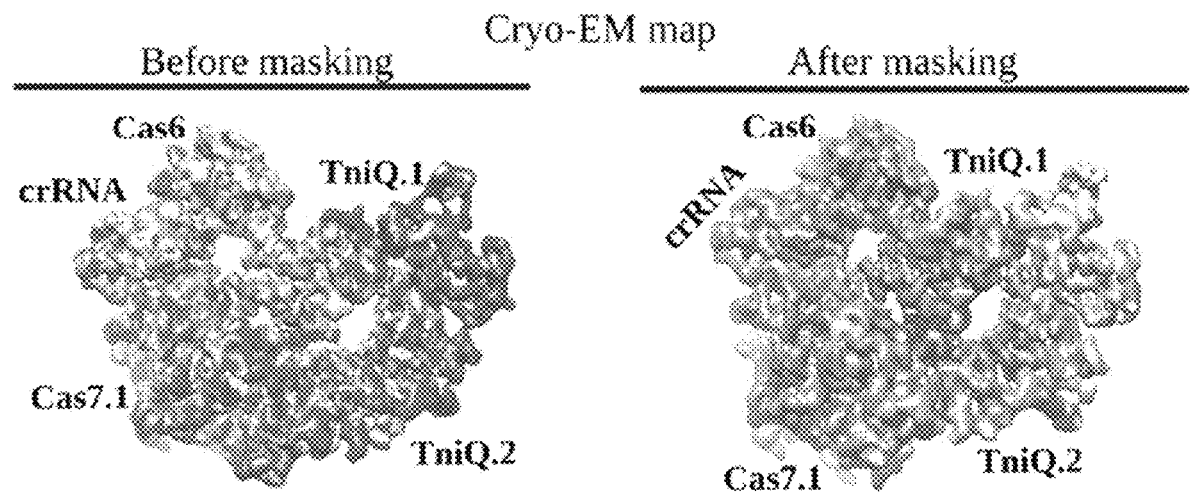
Figure 53E:
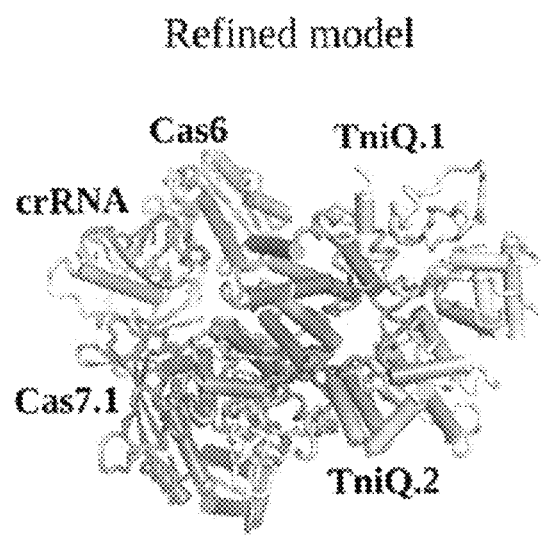

Twenty-two nucleotides of the TS within the 32-bp target showed clear density, but surprisingly, the terminal nine nucleotides were not ordered. The TS base-pairs with the spacer region of the crRNA in short, discontinuous, helical segments, as observed previously for I-E and I-F DNA-bound Cascade complexes with every $6^{th}$ base flipped out of the heteroduplex by the insertion of a Cas7 finger (FIG. 52B). The observed 22-bp heteroduplex was stabilized by the four Cas7 monomers proximal to the PAM (Cas7.6-7.3), but even after local masked refinements, no density was observed for any TS nucleotides that would base-pair with the 3' end of the crRNA spacer bound by Cas7.2 and Cas7.1. These two Cas7 monomers were proximal to Cas6 and in the region previously described to exhibit dynamics due to the interaction of the Cas8 flexible domain with the inner face of the TniQ-dimer. In addition, the disordered nucleotides also corresponded to positions 25-28 of the target site where RNA-DNA mismatches are detrimental for RNA-guided DNA integration. Thus, there is a possibility that the partial R-loop structure may represent an intermediate conformation refractory to integration, and that further structural rearrangements may be critical for further stabilization of an open conformation, possibly driven by recruitment of the TnsC ATPase.

Figure 46A:
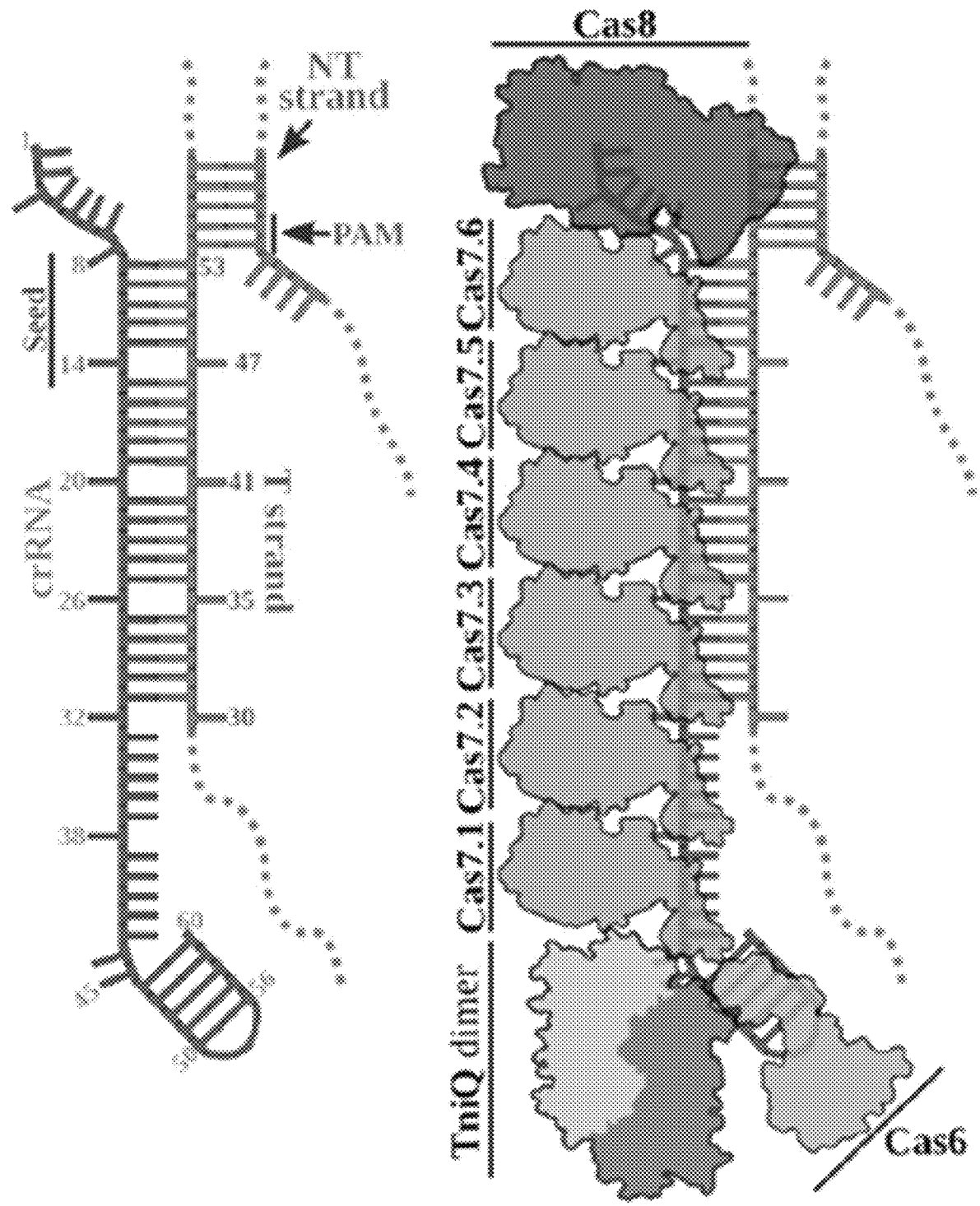
FIGS. 46A-46D are the DNA-bound structure of the TniQ-Cascade complex.
Figure 46B:
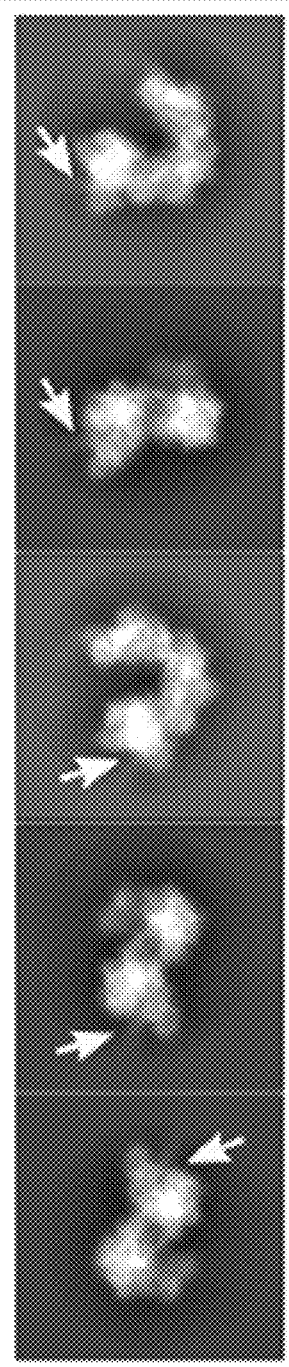
Figure 46C:
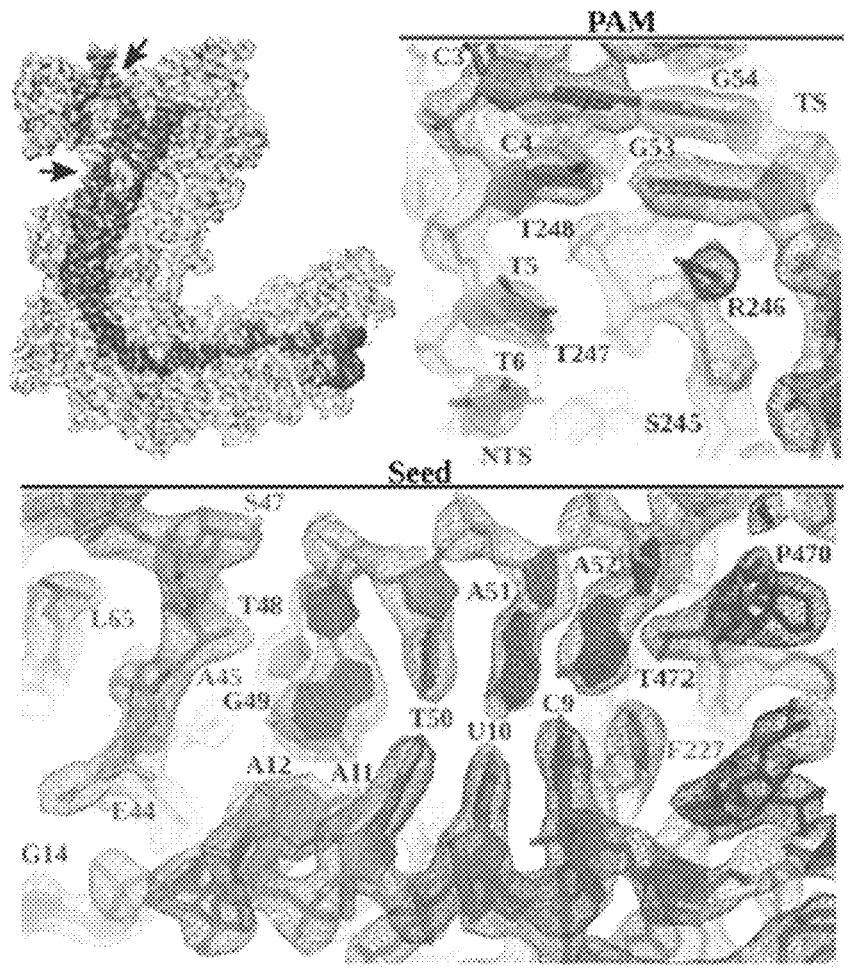
Figure 46D:
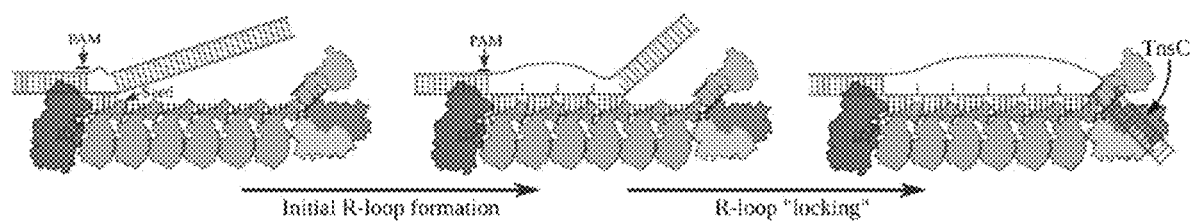

The first cryo-EM structures of a CRISPR-Cas effector complex bound to the transposition protein TniQ, with and without target DNA, revealed the unexpected presence of TniQ as a dimer that formed bipartite interactions with Cas6 and Cas7.1 within the Cascade complex, forming a likely recruitment platform for downstream-acting transposition proteins (FIG. 46D). The structures furthermore revealed a possible fidelity checkpoint, whereby formation of a complete R-loop requires conformational rearrangements that may depend on extensive RNA-DNA complementarity and/or downstream factor recruitment; this proofreading step could account for the highly specific RNA-guided DNA integration previously reported for the *V. cholerae* transposon.

TniQ-Cascade Purification.

Protein components of TniQ-Cascade were expressed from a pET derivative vector containing the native *V. cholerae* tniQ-cas8-cas7-cas6 operon with an N-terminal $His_{10}$-MBP-TEVsite fusion on TniQ. The crRNA was expressed separately from a pACYC derivative vector containing a minimal repeat-spacer-repeat CRISPR array encoding a spacer from the endogenous *V. cholerae* CRISPR array. The TniQ-Cascade complex was overexpressed and purified as described previously and was stored in Cascade Storage Buffer (20 mM Tris-Cl, pH 7.5, 200 mM NaCl, 1 mM DTT, 5% glycerol).

Sample Preparation for Electron Microscopy.

For negative staining, 3 µl of purified TniQ Cascade ranging from 100 nM to 2 M was incubated with plasma treated ($H_2/O_2$ gas mix, Gatan Solarus) CF400 carbon-coated grids (EMS) for 1 minute. Excess solution was blotted and 3 µl of 0.75% uranyl formate was added for an additional minute. Excess stain was blotted away and grids were air-dried overnight. Grid screening for both negative staining and cryo conditions was performed on a Tecnai-F20 microscope (FEI) operated at 200 KeV and equipped with a Gatan K2-Summit direct detector. Microscope operation and data collection were carried out using the Leginon/Appion software. Initial negative staining grid screening allowed determination of a suitable concentration range for cryo conditions. Several grid geometries were tested in the 1-4 µM concentration range for cryo conditions using a Vitrobot Mark-II operated at 4° C., 100% humidity, blot force 3, drain time 0, waiting time 15 seconds, and blotting times ranging from 3-5 seconds. The best ice distribution and particle density was obtained with 0.6/1 UltrAuFoil grids (Quantifoil).

Electron Microscopy.

A preliminary dataset of 300 images in cryo was collected with the Tecnai-F20 microscope using a pixel size of 1.22 Å/pixel with illumination conditions adjusted to 8 e-/pixel/second with a frame window of 200 ms. Preprocessing and image processing were integrally done in Relion3 with ctf estimation integrated via a wrapper to Gctf. An initial model computed using the SGD algorithm implemented in Relion3 was used as initial reference for a refine 3D job that generated a sub-nanometric reconstruction with approximately 10,000 selected particles. Clear secondary structure features in the 2D averages and the 3D reconstruction were identified.

For the DNA-bound TniQ-Cascade complex containing DNA, two complementary 74-nt oligonucleotides were pre-incubated (NTS:
5'TTCATCAAGCCATTGGACCGCCTTACAGGACGCTTTGGCTTCATTGCT
TTTCAGCTTCGCCTTGACGGCCAAAA-3' (SEQ ID NO: 1673), TS:
5'TTTTGGCCGTCAAGGCGAAGCTGAAAAGCAATGAAGCCAAAGCGTCCT
GTAAGGCGGTCCAATGGCTTGATGAA-3' (SEQ ID NO: 1674))

for 5 minutes at 95° C. in hybridization buffer (20 mM Tris-Cl, pH 7.5, 100 mM KCl, 5 mM $MgCl_2$) to form dsDNA, which was subsequently aliquoted and flash frozen. Complex formation was performed by incubating a 3× molar excess of dsDNA with TniQ-Cascade at 37° C. for 5 minutes prior to vitrification, which followed the conditions optimized for the apo complex (defined as TniQ-Cascade with crRNA but no DNA ligand).

High resolution data for the apo complex were collected in a Tecnai-Polara-F30 microscope operated at 300 KeV equipped with a K3 direct detector (Gatan). A 30 m C2 aperture was used with a pixel size of 0.95 Å/pixel and illumination conditions in microprobe mode adjusted to a fluence of 16e-/pixel/second. Four-second images with a frame width of 100 ms (1.77 e-187/Å$_2$/frame) were collected in counting mode.

For the DNA-bound complex, high resolution data were collected in a Titan Krios microscope (FEI) equipped with an energy filter (20 eV slit width) and a K2 direct detector (Gatan) operated at 300 KeV. A 50 m C2 aperture was used with a pixel size of 1.06 Å/pixel and illumination conditions adjusted in nanoprobe mode to a fluence of 8e-/pixel/second. Eight-second images with a frame width of 200 ms (1.42 e-/Å$_2$/frame) were collected in counting mode.

Image Processing.

Motion correction was performed for every micrograph applying the algorithm described for Motioncor2 implemented in Relion3 with 5 by 5 patches for the K2 data and 7 by 5 patches for the K3 data. Parameters of the contrast transfer function for each motion-corrected micrograph were obtained using Gctf integrated in Relion3. Initial particle picking of a subset of 200 images randomly chosen was performed with the Laplacian tool of the Auto-picking module of Relion3, using an estimated size for the complex of 200 Å. 15,000 particles were extracted in a 300 pixels box size and binned 3 times for an initial 2D classification job. Selected 2D averages from this job were used as templates for Auto-picking of the full dataset. The full dataset of binned particles was subjected to a 2D classification job to identify particles able to generate averages with clear secondary structure features. The selected subgroup of binned particles after the 2D classification selection was refined against a 3D volume obtained by SGD with the F20 data. This "consensus" volume was inspected to localize areas of heterogeneity which were clearly identified at both ends of the crescent shape characteristic of this complex. Both ends were then individually masked using soft masks of around 20 pixels that were subsequently used in classification jobs without alignments in Relion3. The T parameter used for this classification job was 6 and the total number of classes was 10. This strategy allowed us to identify two main population of particles which correspond to an "open" and "closed" state of the complex. Particles from both subgroups were separately re-extracted to obtain unbinned datasets for further refinement. New features implemented in Relion3, namely Bayesian polishing and ctf parameters refinement, allowed the extension of the resolution to 3.4, 3.5 and 2.9 Å for the two apo and the DNA-bound complexes, respectively. Post processing was performed with a soft-mask of 5 pixels being the B-factor estimated automatically in Relion3 following standard practice. A final set of local refinements was performed with the masks used for classification. The locally aligned maps exhibit very good quality for the ends of the C-shape. These maps were used for de novo modeling and initial model refinement.

Model Building and Refinement.

For the Cas7 and Cas6 monomers, the *E. coli* homologs (PDB accession code 4TVX) were initially docked with Chimera and transformed to poly-alanine models. Substantial rearrangement of the finger region of Cas7 monomers, as well as other secondary structure elements of Cas6, were performed manually in COOT before amino acid substitution of the poly-alanine model. Well-defined bulky side chains of aromatic residues allowed a confident assignment of the register. The crRNA was also well defined in the maps and was traced de novo with COOT. For Cas8 and TniQ in particular, no structural similarity was found in the published structures able to explain the densities. Locally refined maps using soft masks at both ends of the crescent-shaped complex rendered well-defined maps below 3.5 Å resolution. These maps were used for manual de novo tracing of a poly-alanine model in COOT that was subsequently mutated to the *V. cholerae* sequences. Bulky side chains for aromatic residues showed excellent density and were used as landmarks to adjust the register of the sequence.

For refinement, an initial step of real space refinement against the cryo-EM maps was performed with the phenix.real_space refinement tool of the Phenix package, with secondary structure restraints activated. A second step of reciprocal space refinement was performed in Refmac5, with secondary restraints calculated with Prosmart28 and LibG. Weight of the geometry term versus the experimental term was adjusted to avoid overfitting of the model into cryo-EM map, as previously reported. Model validation was performed in Molprobity.

Data Availability.

Maps and models have been deposited in the EMDB (accession codes 20349, 20350 and 20351) and the PDB (accession codes 6PIF, 6PIG and 6PIJ).

Design and Testing of *V. cholerae* TniQ-Cascade Mutants

Based on the cryo-EM structures of the *V. cholerae* TniQ-Cascade co-complex, both in the apo state and DNA-bound state, a series of point mutations, mutation stretches, or deletions were designed to perturb protein-RNA, protein-DNA, or protein-protein interactions. These mutations were tested for RNA guided DNA integration activity in vivo, in order to screen for variants that may have improved fidelity (i.e. lower off-target integration events) or improved efficiency (i.e. a greater percentage of cells that undergo integration).

In Table 3, the various mutations/deletions are categorized based on which interface or interaction the mutants are designed to modulate. All mutations were introduced into pQCascade (crRNA-4) bacterial expression plasmid that harbors a guide RNA targeting *E. coli* lacZ. Note that "Cas8" in Table 3 refers to the natural Cas8-Cas5 fusion.

TABLE 3

Protein Mutations

| Plasmid ID | Interface being Perturbed | Protein w/ mutation | Mutation |
|---|---|---|---|
| pSL1188 | Flexible domain that interacts with TniQ | Cas8 | Replace N276-N384 with GGSGGSGGSGGSGGS (SEQ ID NO: 1672) |
| pSL1189 | Interaction between Cas8 and 5' crRNA | Cas8 | F415-R424, L583-Y586, and R503 replaced with polyalanine |
| pSL1190 | Interaction between Cas6 and Cas7.1 | Cas6 | E142-I146 replaced with polyalanine |
| pSL1191 | Interaction between Cas6 and TniQ | Cas6 | L11-K23, H73-F84 replaced with polyalanine |
| pSL1192 | Interaction between TniQ and Cas6 | TniQ | E260-L273 replaced with polyalanine |
| pSL1193 | Interaction between TniQ and Cas7.1 | TniQ | H31-D43 replaced with polyalanine |
| pSL1194 | Interaction between TniQ and Cas7.2 | TniQ | E344-D361 replaced with polyalanine |
| pSL0894 | TniQ Zinc finger(s) | TniQ | C128S, C131S |
| pSL0895 | TniQ Zinc finger(s) | TniQ | C150S, H153S |
| pSL0896 | TniQ Zinc finger(s) | TniQ | C128S, C131S, C150S, H153S |
| pSL1243 | TniQ Zinc finger(s) | TniQ | C161S, C163S |
| PSL1244 | TniQ Zinc finger(s) | TniQ | C178S, C181S |
| pSL1245 | Interaction between TniQ and Cas6 | TniQ | E264K |
| pSL1246 | Interaction between TniQ and Cas6 | TniQ | V267D |
| pSL1247 | Interaction between TniQ and Cas6 | Cas6 | K23E |
| pSL1248 | Interaction between TniQ and Cas6 | Cas6 | L20E |
| pSL1249 | Interaction between TniQ and Cas7.1 | TniQ | R32A |
| pSL1250 | Interaction between TniQ and Cas7.1 | TniQ | R32D |
| pSL1251 | Interaction between TniQ and Cas7.1 | TniQ | R39A |
| pSL1252 | Interaction between TniQ and Cas7.1 | TniQ | R39D |
| pSL1253 | Interaction between TniQ and Cas7.1 | TniQ | D43A |
| pSL1254 | Interaction between TniQ and Cas7.1 | TniQ | D43R |
| PSL1255 | Interaction between TniQ and Cas7.1 | Cas7 | D180A |
| pSL1256 | Interaction between TniQ and Cas7.1 | Cas7 | D180R |
| pSL1257 | Interaction between TniQ and Cas7.1 | Cas7 | R172A |
| pSL1258 | Interaction between TniQ and Cas7.1 | Cas7 | R172D |
| pSL1259 | TniQ dimerization Interface | TniQ | Deletion of Y365-W394 |
| pSL1260 | TniQ dimerization Interface | TniQ | Deletion of F380-W394 |
| pSL1261 | TniQ dimerization Interface | TniQ | Deletion of F385-W394 |
| pSL1262 | TniQ dimerization interface | TniQ | Deletion of Y390-W394 |
| pSL1263 | PAM recognition by Cas8 | Cas8 | S127A |
| pSL1264 | PAM recognition by Cas8 | Cas8 | R243A |
| pSL1265 | PAM recognition by Cas8 | Cas8 | N246A |
| pSL1270 | TniQ Zinc finger(s) | TniQ | C150S, H153S, C178S, C181S |
| PSL1271 | TniQ Zinc finger(s) | TniQ | C161S, C163S, C178S, C181S |
| pSL1272 | TniQ Zinc finger(s) | TniQ | C128S, C131S, C161S, C163S |
| pSL1299 | Stabilization of crRNA/DNA by Cas7 | Cas7 | F227A |
| pSL1300 | Stabilization of crRNA/DNA by Cas7 | Cas7 | F227Y |

TABLE 3-continued

Protein Mutations

| Plasmid ID | Interface being Perturbed | Protein w/ mutation | Mutation |
|---|---|---|---|
| pSL1301 | Interaction between Cas8 and 5' crRNA | Cas8 | R424A |
| pSL1302 | Interaction between Cas8 and 5' crRNA | Cas8 | R503A |
| pSL1303 | Interaction between Cas8 and 5' crRNA | Cas8 | R584A |

TABLE 4

Data collection, refinement and validation statistics

| Data collection | VC-Tn6677-effector | VC-Tn667-effector-DNA |
|---|---|---|
| Microscope - detector | Polara-F30 - K3 | Titan Krios - K2 |
| Voltage (KeV) | 300 | 300 |
| Defocus range (μm) | −3/−3 | −0.5/−2 |
| Pixel size (Å/pixel) | 0.95 | 1.06 |
| Total dose ($e^-/Å^2$) | 70.91 | 56.95 |
| Dose/frame ($e^-/Å^2$) | 1.77 | 1.42 |
| Images collected | 10.661 | 3.679 |

| | class | |  |
|---|---|---|---|
| Data processing | open | close | |
| Final particles | 52.316 | 52.987 | 88.055 |
| FSC 0.143 (Å) | 3.47 | 3.47 | 2.94 |
| Map sharpening (Å) | −71.91 | −77.07 | −34.23 |
| Model refinement | | | |
| Resolution used in refinement (Å): | 3.5 | 3.5 | 3 |
| Average B-factor: (Å) | 92.47 | 96.5 | 93.90 |
| R.m.s. deviations: | | | |
| Bonds (Å) | 0.014 | 0.014 | 0.016 |
| Angles (°) | 1.77 | 1.78 | 1.78 |
| Validation | | | |
| Molporbity score | 2.34 | 1.81 | 1.82 |
| Clashcore, all atoms | 6.89 | 1.82 | 3.32 |
| Favored ratamers (%) | 81.38 | 81.4 | 82.31 |
| Ramachandran plot: | | | |
| Outliers (%) | 3.91 | 3.45 | 3.47 |
| Favored (%) | 81.38 | 81.41 | 82.31 |
| Deposition | | | |
| EMDB-ID | 20349 | 20350 | 20351 |
| PDB-ID | 6PIF | 6PIG | 6PIJ |

Example 10

RNA-Guided DNA Integration Using Engineered TnsA-TnsB Fusions

A class of transposon that encode fusions between the TnsA endonuclease and the TnsB DDE-family integrase was identified. These TnsA-TnsB fusion genes exist in multiple distinct Tn7-like transposon families, and they were identified in Tn7-like transposons that encode Type I-F variant CRISPR-Cas systems with genes homologous to the genes in the *V. cholerae* Tn6677 transposon. Here, engineered versions of the machinery derived from the Tn6677 *V. cholerae* transposon convert the separate TnsA and TnsB polypeptides into a single fusion TnsA-TnsB fusion polypeptide, which retains in vivo function for RNA-guided DNA integration activity, thereby reducing the complexity of the system by one component.

Expression Vector Design

Figures 66, 67A:
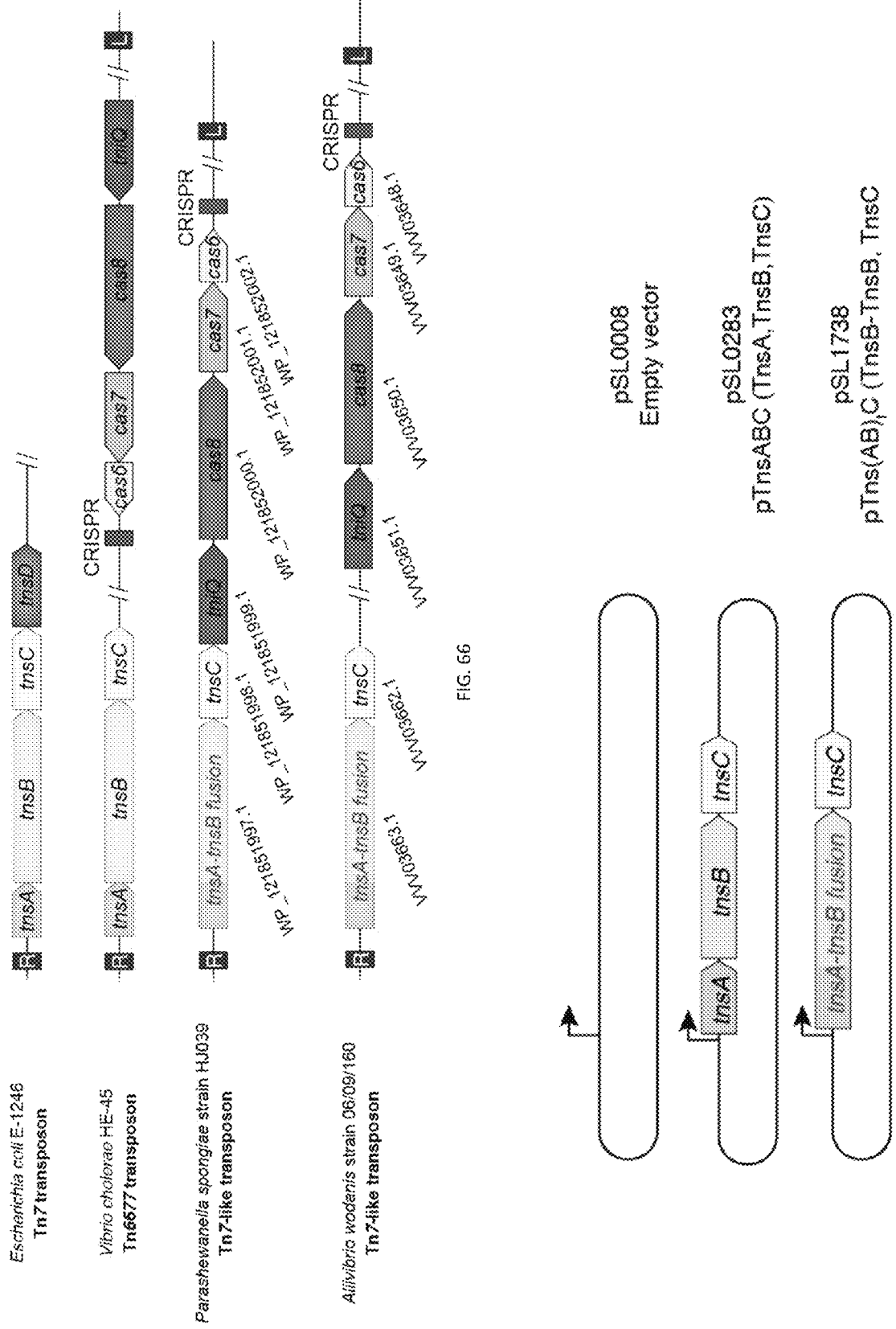
FIG. 66 are schematics of the occurrence of tnsA-tnsB fusions in Tn7-like transposons that encode Type I-F CRISPR-Cas systems. Gene organization of the transposon and CRISPR-Cas machinery from select transposons, including *E. coli* Tn7 (top), *V. cholerae* Tn6677 (second from top), and new candidate Tn7-like transposons from *Parashewanella spongiae* (second from bottom) and *Aliivibrio wodanis* (bottom). In the bottom two examples, there is a natural fusion between tnsA-tnsB. Genes from the CRISPR-Cas operon are also indicated (tniQ, cas8, cas7, cas6, and the CRISPR array). The protein accession IDs for the bottom two systems are denoted below the gene schematics. "R" and "L" denote the right and left ends of the transposon, respectively.
FIGS. 67A and 67B are the design and testing of engineered TnsA-TnsB fusion proteins from the *V. cholerae* Tn6677 transposon. Starting with the pTnsABC vector, which encodes the natural TnsA, TnsB, and TnsC operon from *V. cholerae*, a synthetic fusion of TnsA-TnsB was constructed based on alignments with other naturally occurring TnsA-TnsB fusions, to generate a new modified pTns (AB)$_f$C vector, pSL1738 (FIG. 67A and SEQ ID NO: 935). *E. coli* BL21(DE3) competent cells that already contained a mini-transposon plasmid donor (pDonor; pSL0527, SEQ ID NO: 7) and a plasmid encoding the TniQ-Cascade(crRNA-4) complex (pSL0828, SEQ ID NO: 14) were transformed with either an empty vector as control (pSL0008, SEQ ID NO: 3), the original pTnsABC vector (encoding TnsA, TnsB, and TnsC), or the new engineered vector containing a TnsA-TnsB fusion protein alongside TnsC (pSL1738). Integration efficiency was quantified by qPCR for both of two possible integration orientations downstream of target-4, tRL and tLR (FIG. 67B). The engineered fusion protein exhibited close to the same activity of wild-type as the pSL0283/pTnsABC (SEQ ID NO: 13) construct, demonstrating that engineered TnsA-TnsB fusion proteins are functional in vivo for RNA-guided DNA integration.

Based on sequence alignments between TnsA and TnsB proteins from the *V. cholerae* Tn6677 transposon, and TnsA-TnsB fusion proteins from newly identified transposons in *Parashewanella spongiae* strain HJ039 and *Aliivibrio wodanis* strain 06/09/160 (FIG. 66), a new engineered *V. cholerae* TnsA-TnsB fusion construct was engineered by modifying the sequences in pSL0283, in order to generate pSL1738 (FIG. 67A). These plasmid sequences are represented by SEQ ID NOs: 3, 6, and 935 and the sequence of the fusion *V. cholerae* TnsA-TnsB protein is SEQ ID NO: 935.

Functional Testing of Fusion TnsA-TnsB Proteins

Figure 67B:
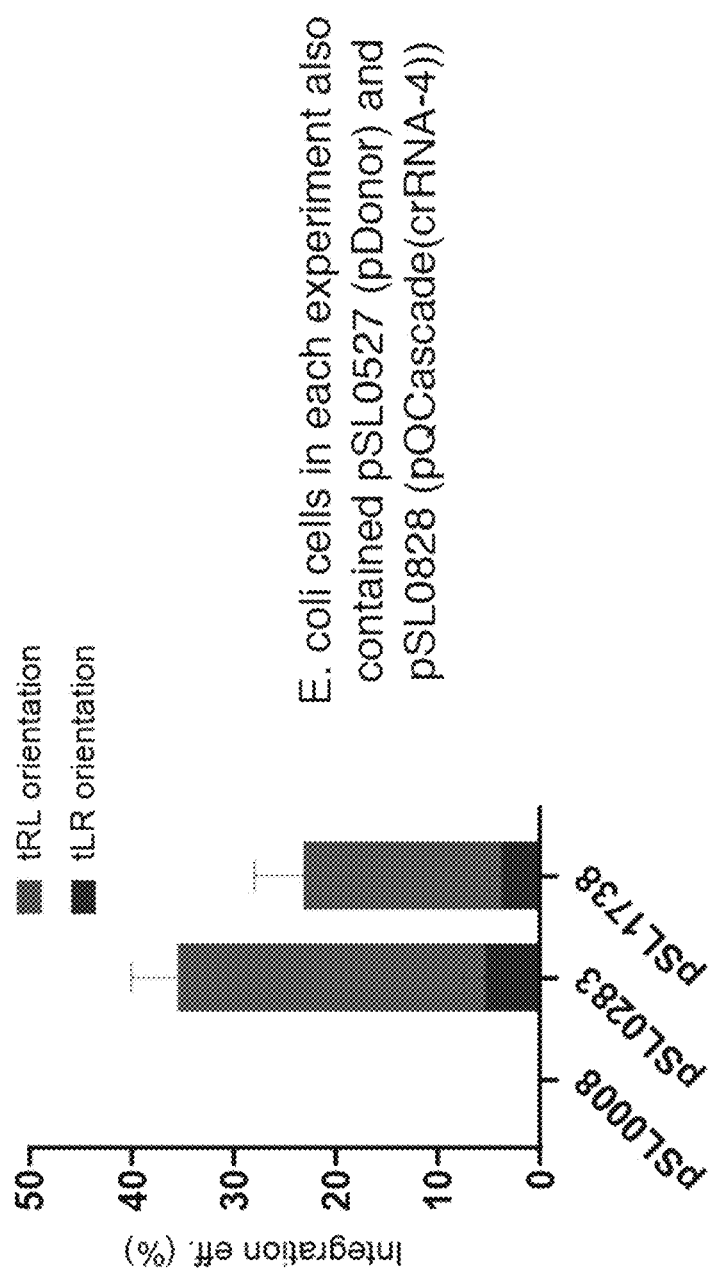

In order to test the engineered TnsA-TnsB fusion protein for in vivo RNA-guided DNA integration activity, transposition experiments were performed in *E. coli* following a similar protocol as previously described here and in Klompe et al., Nature 571, 219-225 (2019), incorporated herein by reference). Briefly, chemically competent *E. coli* BL21 (DE3) cells that contained a plasmid-encoded mini-transposon donor DNA, pSL0527, and a plasmid expressing the TniQ-Cascade complex with crRNA-4, pSL0828 were generated. These cells were transformed with either an empty vector control (pSL0008; pCOLADuet-1), the original wild-type pTnsABC plasmid that encodes *V. cholerae* TnsA, TnsB, and TnsC (pSL0283), or a new plasmid encoding TnsC and the engineered TnsA-TnsB fusion construct (pSL1738). Integration was assessed by qPCR, in which primer pairs selectively amplify novel genome-mini-transposon junctions and allow quantification of the integration efficiency for both of two possible orientations, denoted tRL (target-right end-left end) and tLR (target-left end-right end). The results demonstrated that the fusion TnsA-TnsB protein has nearly wild-type activity for RNA-guided DNA integration (FIG. 67B).

These experiments demonstrated that synthetic, engineered fusions of TnsA and TnsB are fully functional for RNA-guided DNA integration, and that these engineered fusion proteins may be considered as alternative modalities for engineering experiments, particularly in cells where expression and/or delivery of the machinery may be improved or streamlined through use of a system containing reduced number of total molecular components. Previous results also showed that the TniQ-Cas8/Cas5-Cas7-Cas6 operon could be engineered to encode a TniQ-Cas6 fusion protein, and that this fusion protein also supported RNA-guided DNA integration activity in vivo, providing another example of an engineered system containing fewer parts. Additional functional fusion designs may be used to further reduce the number of components, through fusions between the pre-existing components, or fusions to additional DNA targeting or DNA cleaving/integrating components.

Example 11

Engineering Transposon End DNA Sequences to Increase RNA-Guided DNA Integration Efficiency and Modulate Integration Orientation RNA-guided DNA integration by the *V. cholerae* CRISPR-transposon derived from Tn6677 requires conserved transposon end sequences, as described above. Specifically, mini-transposon donor DNA sequences have "Left (L)" and "Right (R)" transposon ends for proper recognition by the TnsA/TnsB heteromeric transposase, and deletion of substantial portions of either transposon end sequence leads to a partial or complete loss of RNA-guided DNA integration activity (FIGS. 11A-C). Integration generally occurs bidirectionally at a fixed distance downstream of DNA target sites complementary to the CRISPR RNA (crRNA), as described above. Specifically, across a population of cells, integration events are heterogeneous, with some occurring such that the R end of the transposon is proximal to the target site (a T-RL orientation), whereas others occur with the L end of the transposon proximal to the target site (a T-LR orientation). Whereas some sites show a roughly 50:50 ratio of T-RL and T-LR insertion products (e.g. at the site complementary to crRNA-4), in general, the T-RL orientation is strongly preferred over the T-LR orientation.

Large libraries of mutagenized transposon L and R sequences were generated to identify higher-activity variants, and variants with altered orientation biases, using a high-throughput pooled library approach.

Verification of Transposon End Truncation Variants at Multiple Target Sites

Figure 68:
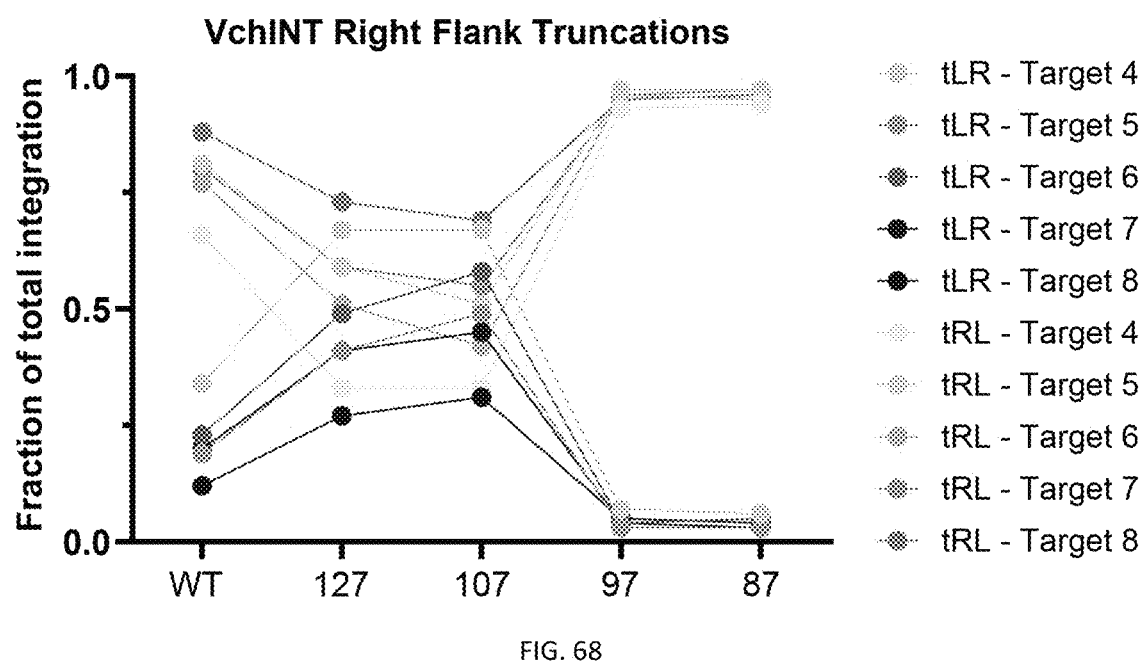
FIG. 68 is a graph showing influence of right transposon end sequence truncations on the preferred orientation of RNA-guided DNA integration, verifying results from FIG. 11C at four additional target sites. The x-axis shows the length of the right transposon end sequence. Blue tones indicate T-LR (R end of the transposon is proximal to the target site) integration events whereas orange tones indicate T-RL integration events (R end of the transposon is proximal to the target site). Truncating the right transposon end to 97 bp or shorter caused a shift towards preferred integration in the TRL orientation (~95% of integration events) and was consistent for all target sites tested.

Previous data (FIG. 11) demonstrated that sequence features present in the transposon end sequences controlled insertion and orientation. Particularly, a shift in the preferred orientation of integration was observed when the right transposon end was truncated into a palindromic sequence present just inside of the TnsB binding sites. The same donor constructs (pSL0527, pSL0708, pSL0710, pSL0711, pSL0712) were tested at different target sites (tSL0005-tSL0008). Briefly, competent BL21(DE3) E. coli cells already carrying a vector for the expression of TnsA, TnsB, and TnsC (pSL0283) were co-transformed with a vector expressing TniQ, Cascade and a CRISPR array targeting the different target sites (pSL0829-pSL0832 for tSL0005-tSL0008, respectively), and a vector encoding the truncation variants of the mini-transposon. Truncating the right transposon end to 97 bp or shorter (FIG. 68) resulted in integration preferentially in the T-RL orientation (at about 95% of all integration events).

Methods for High-Throughput Transposon End Sequence Engineering and Testing

Figure 69:
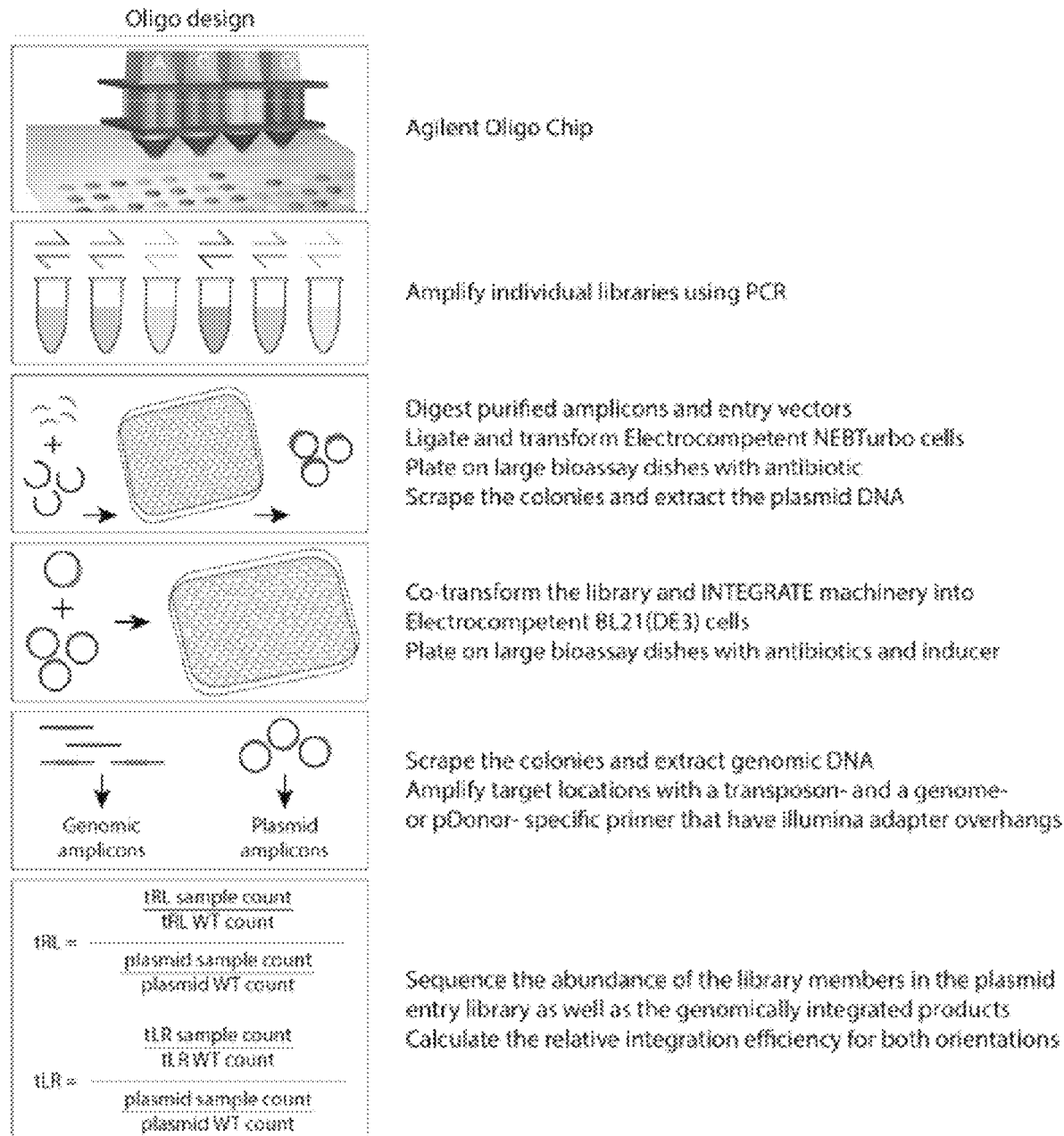
FIG. 69 is a schematic of an exemplary approach to generate and test engineered transposon end sequences in pooled library experiments.

Pooled libraries of engineered transposon end sequences were generated using oligoarray synthesis (FIG. 69). Briefly, oligonucleotides were designed as multiple sub-libraries within a single large pooled library, and synthesized by Agilent. Each sub-library was amplified from the pool using unique primer pairs. The PCR amplicons and their designated backbone vectors were digested with matching restriction enzymes, the purified digestion products were ligated, and these ligation products were then used to transform electrocompetent E. coli NEB Turbo cells. Transformation reactions were plated on large LB-agar bioassay dishes with the appropriate antibiotic and grown overnight at 37° C. The colonies were then scraped and resuspended in LB, from which plasmid DNA was purified. These pooled plasmid libraries were deep sequenced to assess the starting input library (see below), and used in subsequent transposition assays. Separate transposon end libraries were designed and prepared for the Right (R) and Left (L) transposon ends. These rationally designed libraries contained the wild-type transposon end sequence as well as perturbations that included from among the following:

a) all six predicted TnsB binding sites (TBSs), as well as a palindromic sequence close to the TBSs (herein numbered from 1-7) were arranged in all possible permutations of three to constitute a new transposon right end;

b) all six predicted TnsB binding sites (TBSs), as well as a palindromic sequence close to the TBSs (herein numbered from 1-7) were arranged in all possible permutations of two to constitute a new transposon right end;

c) 2-bp mutations that were tiled throughout the entirety of the transposon right end;

d) all possible 1-bp mutations within the terminal 8-bp of the transposon right end;

e) mutations to the right transposon end to replace stop codons with regular codons and to substitute codons encoding bulky/charged amino acids with codons encoding amino acids more suitable to function as a protein linker;

f) variable spacing between the TBSs of the transposon right end; and g) variable spacing between the TBSs of the transposon left end.

Figure 70:
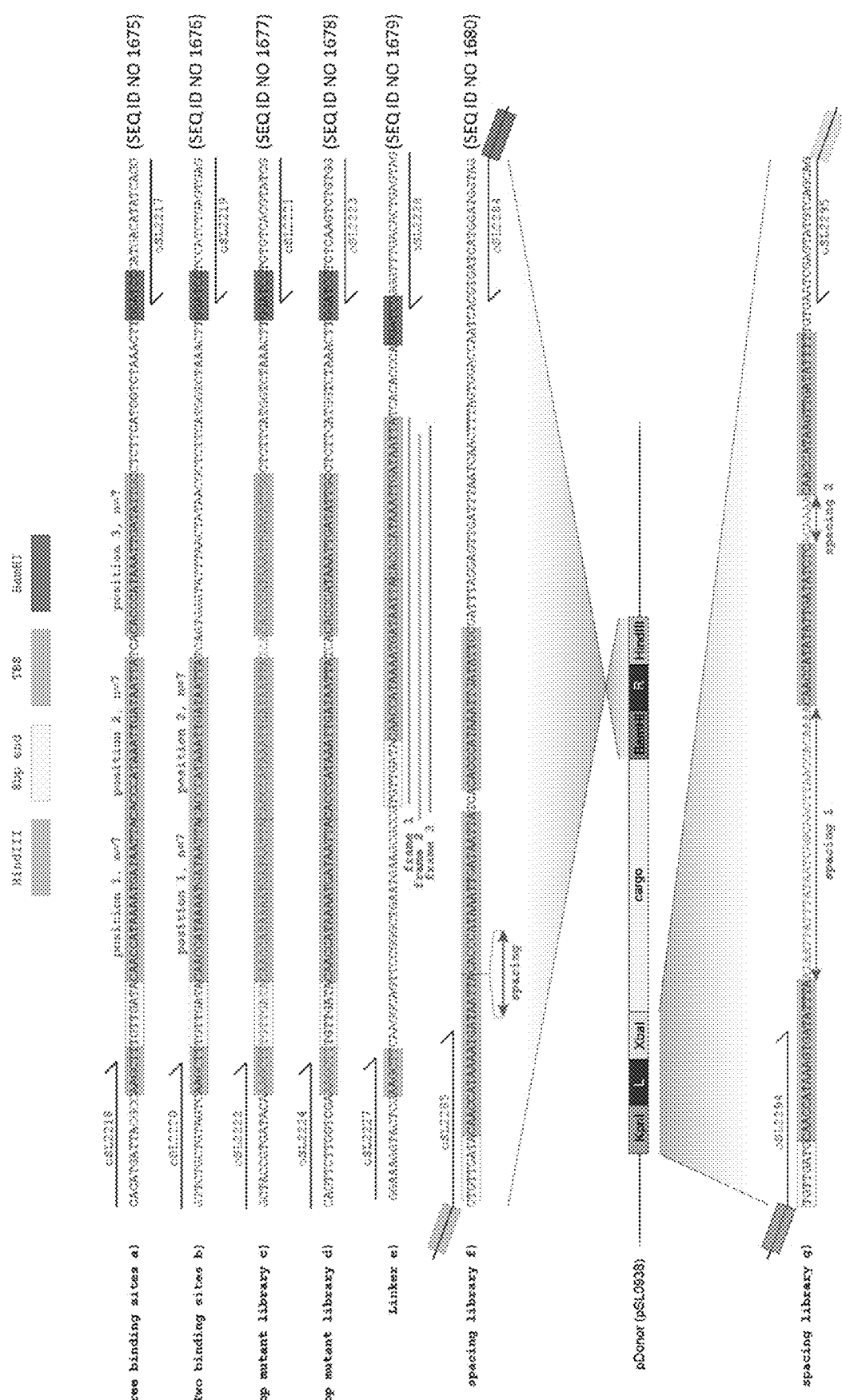
FIG. 70 is a schematic of an exemplary cloning approach for generating separate transposon end libraries from an oligo pool. Right transposon end libraries are generated by digesting the insert and vector with HindIII and BamHI. Left transposon end libraries are generated by digesting with KpnI and XbaI. For library a) every possible combination of TnsB binding sites for three different positions was generated. For library b) every possible combination of TnsB binding sites for two different positions was generated. Library c) contained 2 bp mutations throughout the right flank. Library d) constituted all possible 1 bp mutations for the 8 bp right terminal end. Library e) included missense mutations affecting the three different possible open reading frames for the right transposon end. Library f) changed the distance between the TnsB binding sites in position 1 and position 2. The left transposon end library g) changed the distance between the TnsB binding sites in position 1 and 2 or between positions 2 and 3. The same spacing sequence were also separately mutated to compare the effect of distance and sequence identity.
Figure 71A:
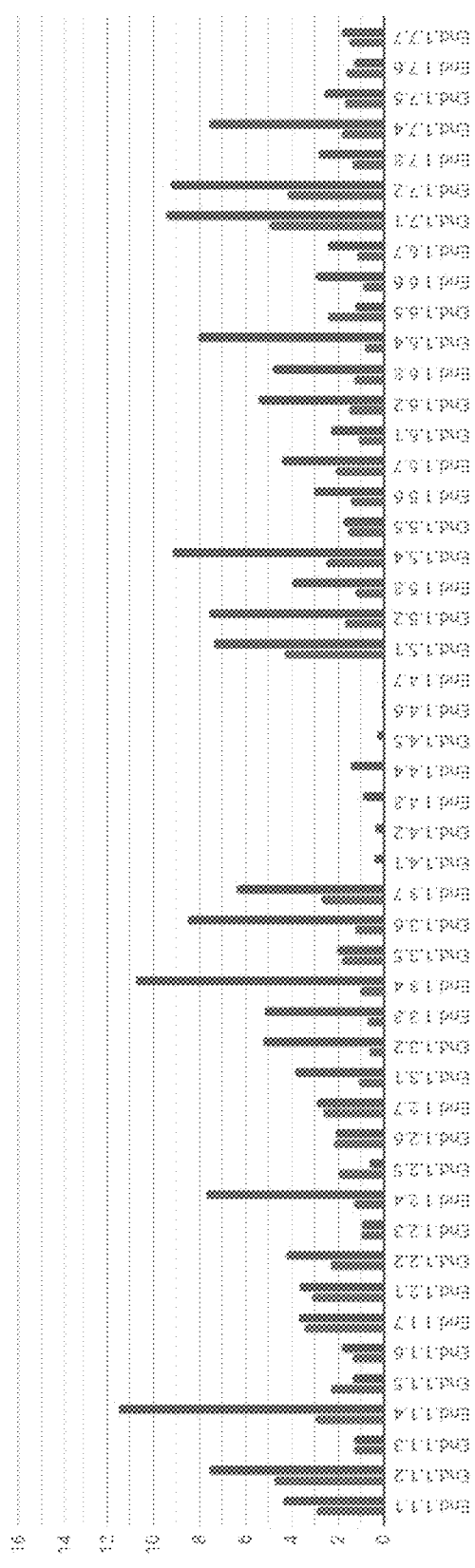
FIGS. 71A-71G are graphs of the relative integration efficiencies for members of the 'Right Flank Three Binding Sites' library (library a). The two different orientations in which the transposon can integrate are shown in blue (T-RL (tRL)) and red (T-LR (tLR)). The relative integration efficiency was calculated against variant END. 1.2.3 which most closely resembles the natural transposon end (END. 1.2.3 is a 90 bp truncated version of the standard pDonor of which the orientation bias is expected to be heavily skewed towards tRL). In this library, the locations of the three TnsB binding sites in the right end were maintained but their identities were changed to create all possible combinations of the six different TnsB binding site identities, the location of a palindromic sequence that is naturally present just inside of the transposon right end was also tested. These seven different sequences were numbered 1-7 (SEQ ID NOs: 936-942, respectively). The x-axis shows which TnsB binding site identity (1-7) was present in position 1, and 2, counting from the terminal transposon right end (see FIG. 68).
Figure 71B:
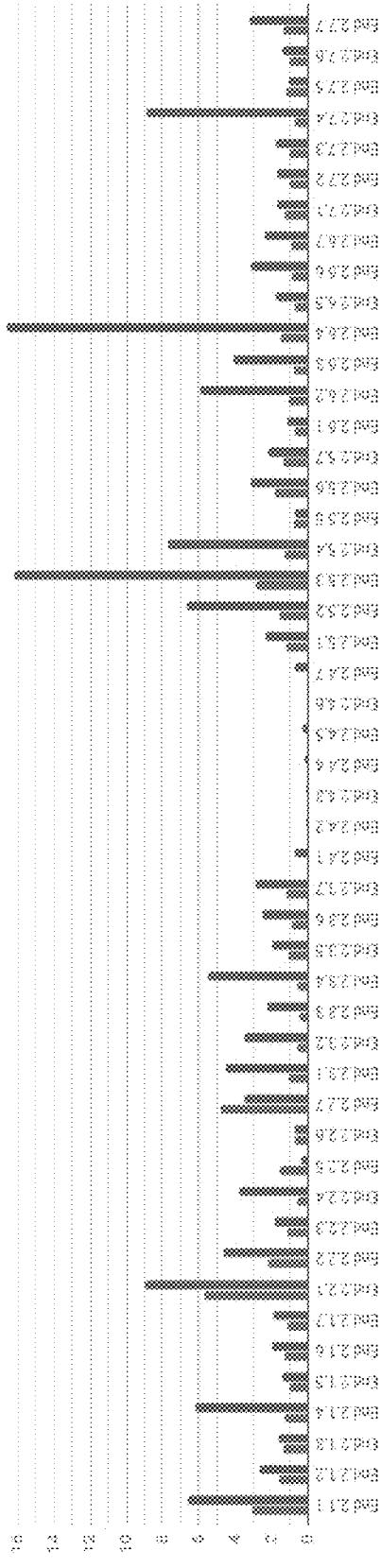
Figures 71C, 71D:
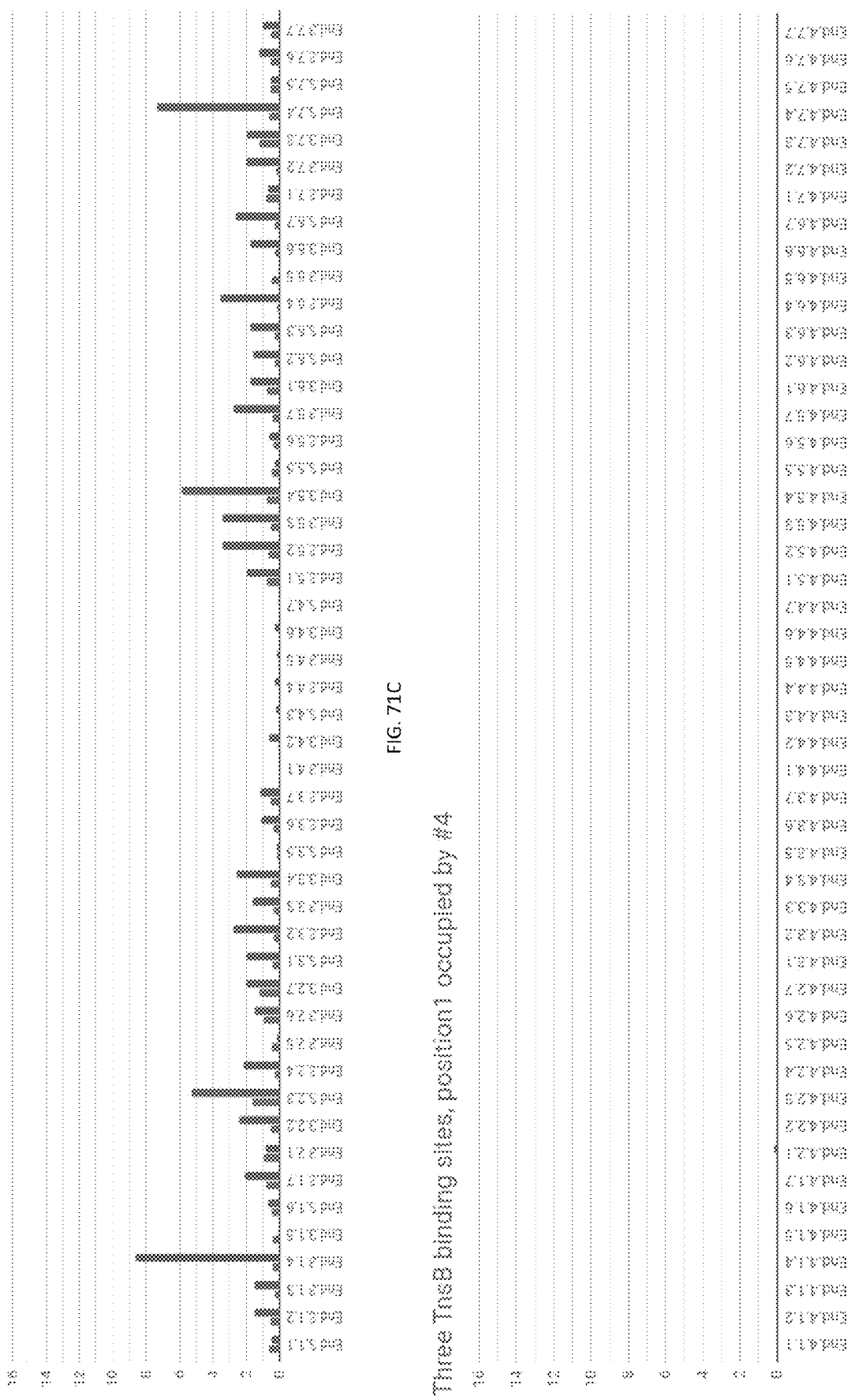
Figure 71E:
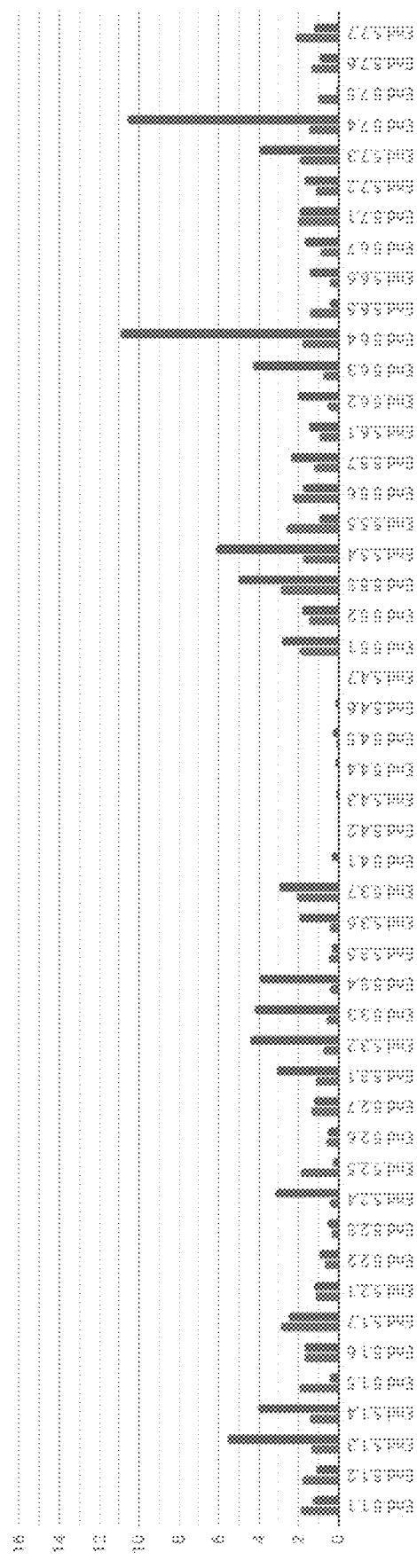
Figure 71F:
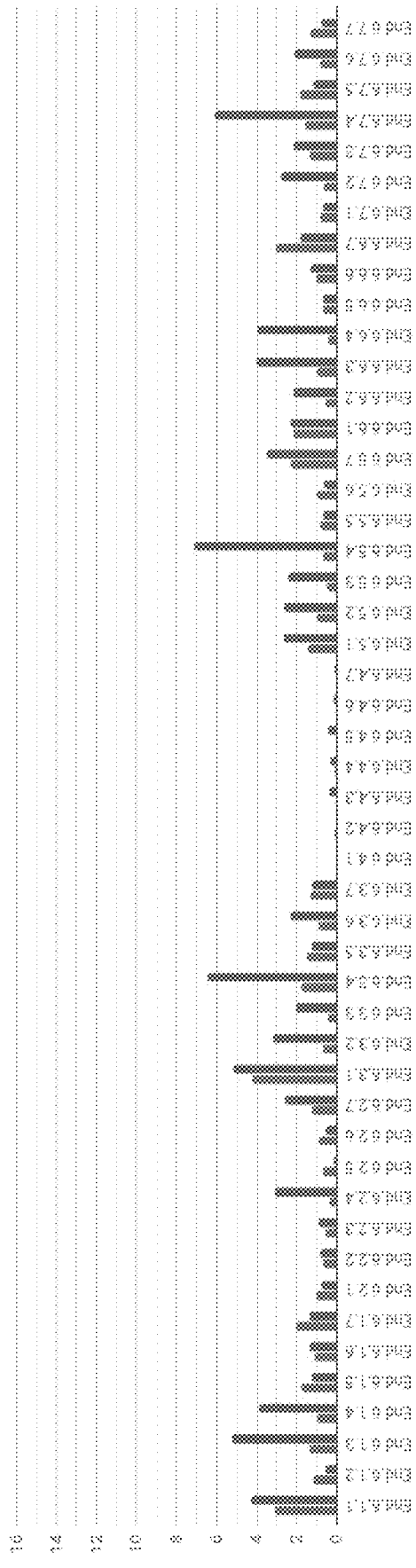
Figure 71G:
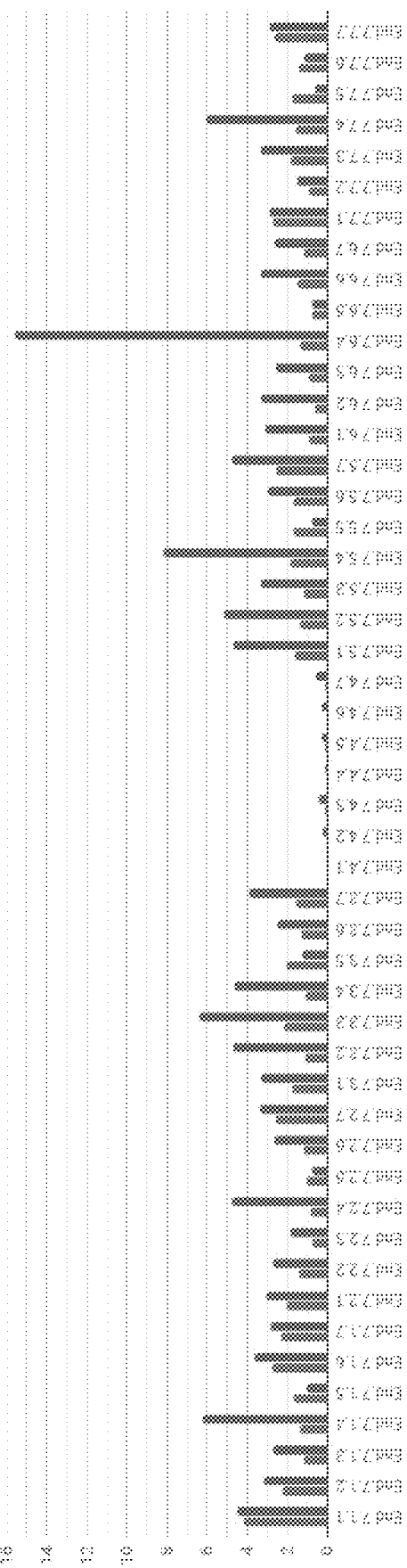

Altered transposon right (R) end sequences were cloned into the pSL0938 plasmid backbone. Briefly, individual libraries were PCR amplified using unique primers (addendum 11.1) and were digested with BamHI and HindIII. pSL0938 was similarly digested with the addition of a dephosphorylation step. The digestion products were purified (either from gel or using a PCR clean-up kit) and ligated in multiple separate reactions. The separate reactions were combined, purified, and used to transform NEBTurbo E. coli cells by electroporation. The entire transformation reaction was plated on large bioassay dishes to ensure obtaining enough colonies to represent the diversity present in the library. The next day the colonies were resuspended in LB and used for plasmid extraction. A schematic of the cloning strategy can be found in FIG. 70. Sequences of all sequence variants of the transposon right end can be found in SEQ ID NOS: 955-1521.

Altered transposon left (L) end sequences were cloned into the pSL0938 plasmid backbone, using the same cloning strategy as for the transposon right end library with the exception that digestion was done using XbaI and KpnI. A schematic of the cloning strategy can be found in FIG. 70. Sequences of all sequence variants of the transposon left end can be found in SEQ ID NOS: 1524-1611.

Protocol for Testing RNA-Guided DNA Integration Activity of Variant Transposon Libraries Approximately 200 ng of the individual Right or Left Flank libraries were transformed into electrocompetent BL21(DE3) together with ~200 ng pSL1022 (pMachinery, expresses the CRISPR array (target 4), TniQ, Cascade, and TnsABC from a single T7 promoter on a pCDFDuet-1 backbone with spectinomycin resistance). Transformed cells were plated on agar plates with carbenicillin/spectinomycin/IPTG (0.1 mM) and grown at 37° C. for 24 h. After growth, the colonies were scraped from the plate and resuspended in LB. The equivalent of 1 ml of overnight liquid culture (roughly $5.6 \times 10^9$ cells) was used to extract genomic DNA using a Wizard® Genomic DNA Purification Kit (Promega).

Integration events at the genomic target site were amplified by 20 cycles of PCR using a transposon- and genome-specific primer that carry Illumina adapters. The PCR reaction was diluted 1:20 into a second PCR reaction (PCR2) where 10 cycles add specific barcodes to the Illumina adapters. Fractions of PCR2 were run on a gel, and based on the intensity of their bands the original stocks were combined. The resulting combined samples were run on gel and extracted. After library quantification by qPCR, the combined library was sequenced on an Illumina NextSeq using a Mid output kit with 250 nt single-end reads. The same PCR approach was used for the original plasmid libraries to sample the diversity of the library and the relative abundances of each variant.

To calculate the relative integration efficiencies of each transposon variant, the number of reads for each variant were normalized to a fraction of wildtype reads. These normalized numbers were then used to calculate the difference in abundance between the starting plasmid library and the genomically integrated transposons.

Profiling of RNA-Guided DNA Integration Activity with Variant Transposon Libraries Library a) tested all possible combinations of TnsB binding sites in three different positions in the right transposon end (FIGS. 71A-71G). Some high efficiency variants were identified. Particularly, variants with multiple copies of the most terminal and middle TnsB binding site from the right transposon ends. Library b) tested all possible combinations of TnsB binding sites in two different positions in the right transposon end (FIG. 72). Library b) results corroborated the results from library a), since a variant with two copies of the most terminal TnsB binding site from the right transposon end greatly increased integration efficiencies.

Figure 73:
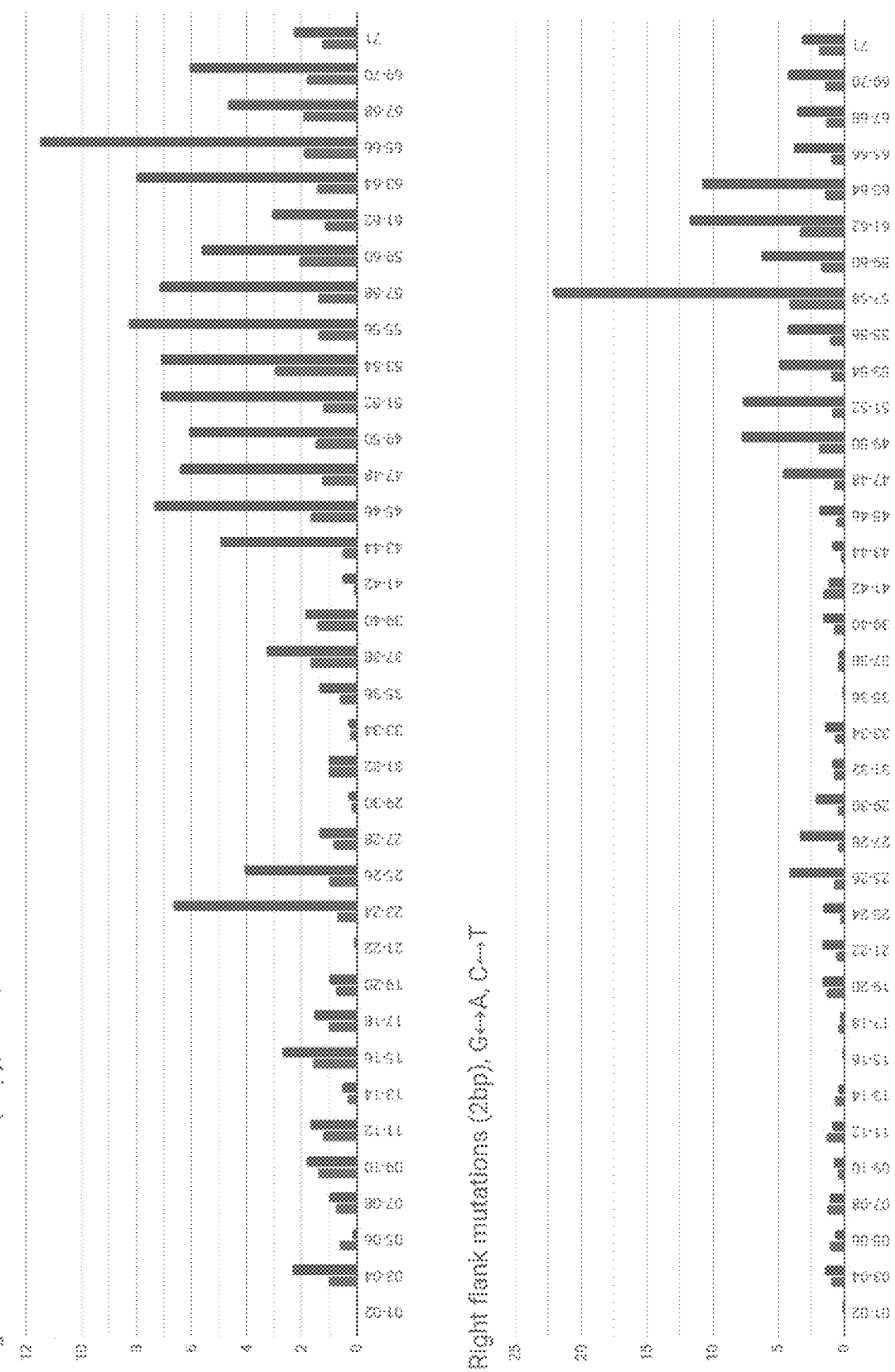
FIG. 73 is graphs of the relative integration efficiencies for members of the 'Right Flank 2 bp Mutant' library (library c). The two different orientations in which the transposon can integrate are shown in blue (T-RL) and red (T-LR). The relative integration efficiency was calculated against variant END.1.2.3. The x-axis indicates the location of the affected bases counting from the most terminal right transposon end base.
Figure 74:
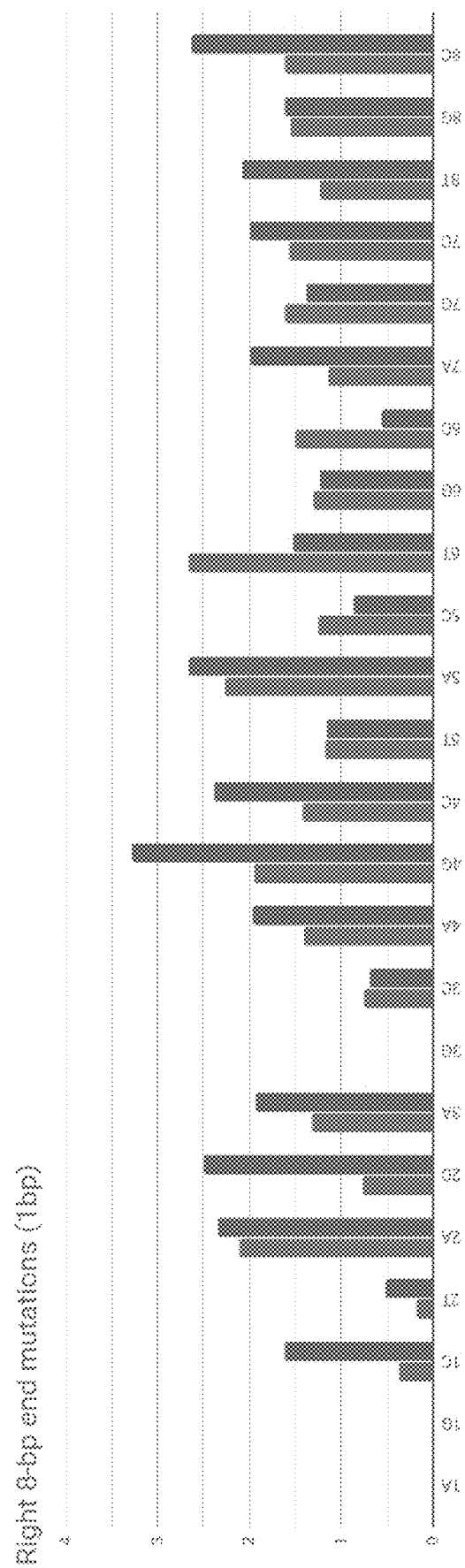
FIG. 74 is a graph of the relative integration efficiencies for members of the 'Right Flank End Mutant' library (library d). The two different orientations in which the transposon can integrate are shown in blue (T-RL) and red (T-LR). The relative integration efficiency was calculated against variant END.1.2.3. The x-axis indicates both the location of the base that was changed counting from the most terminal base pair and the new nucleotide identity.
Figure 75A:
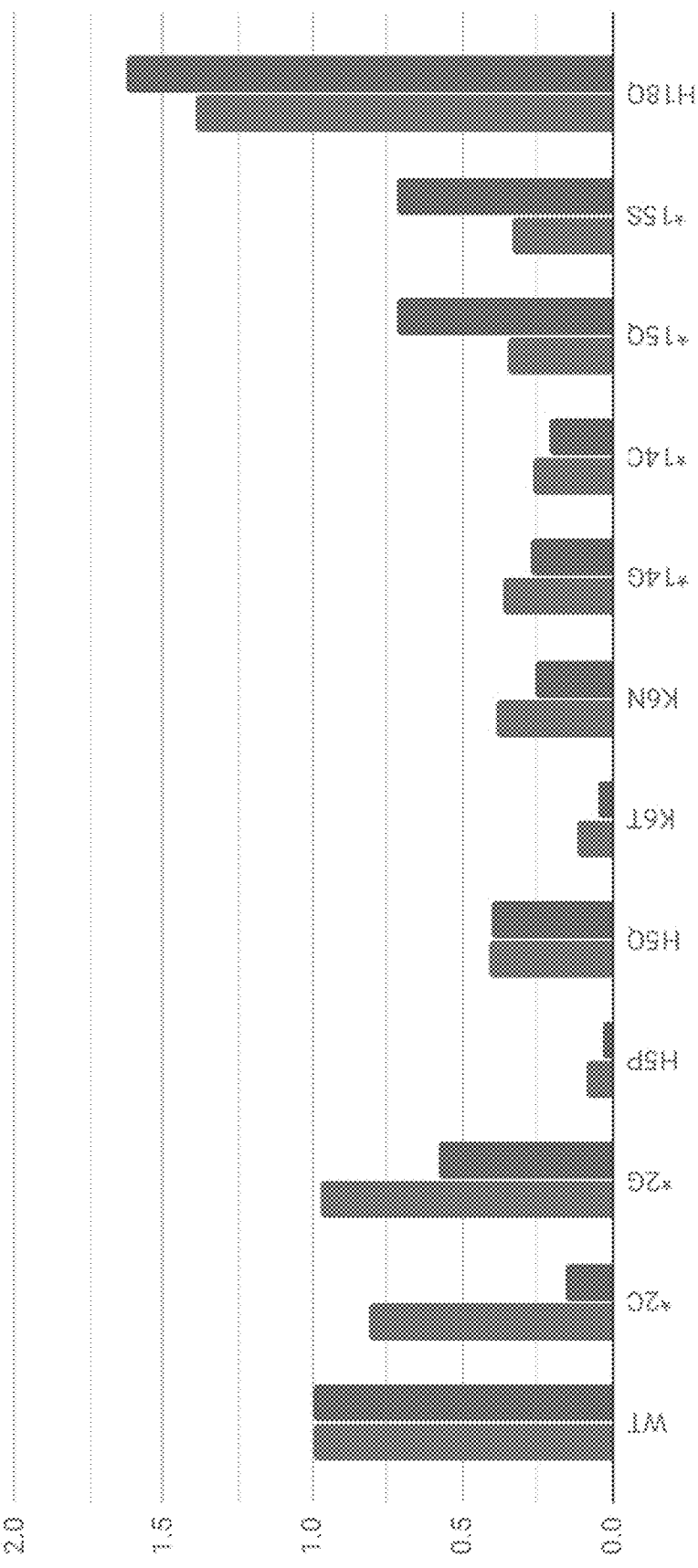
FIGS. 75A-C are graphs of the relative integration efficiencies for members of the 'Right Flank Linker Sequence' library (library e). The two different orientations in which the transposon can integrate are shown in blue (T-RL) and red (T-LR). The relative integration efficiency was calculated against variant END. 1.2. The x-axis indicates the amino acid change caused by the mutation.
Figure 75B:
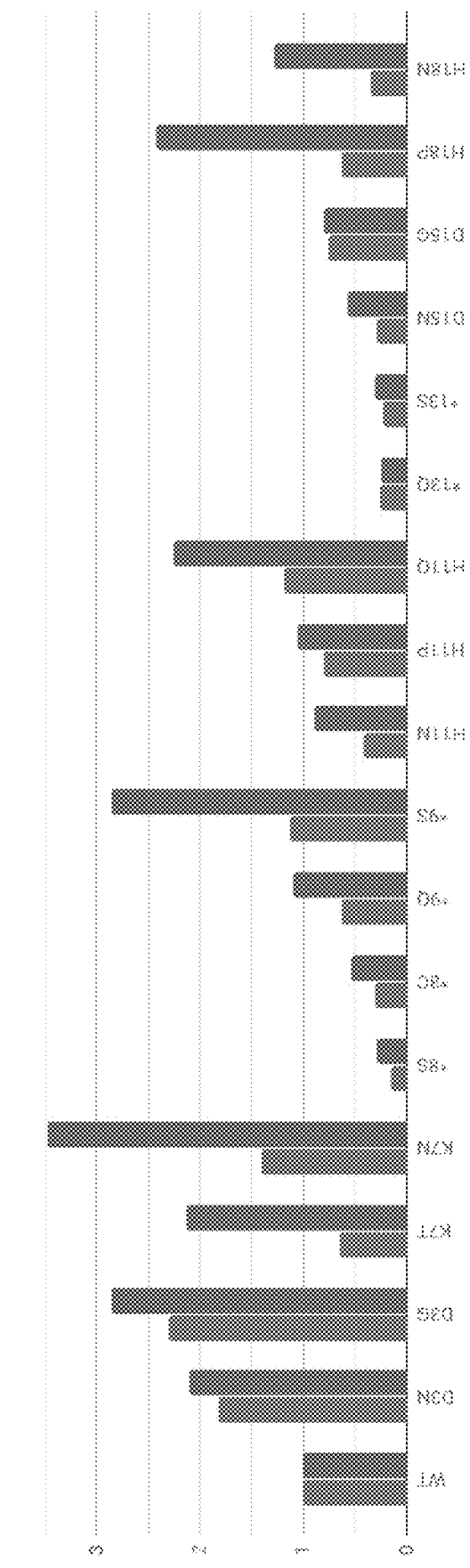
Figure 75C:
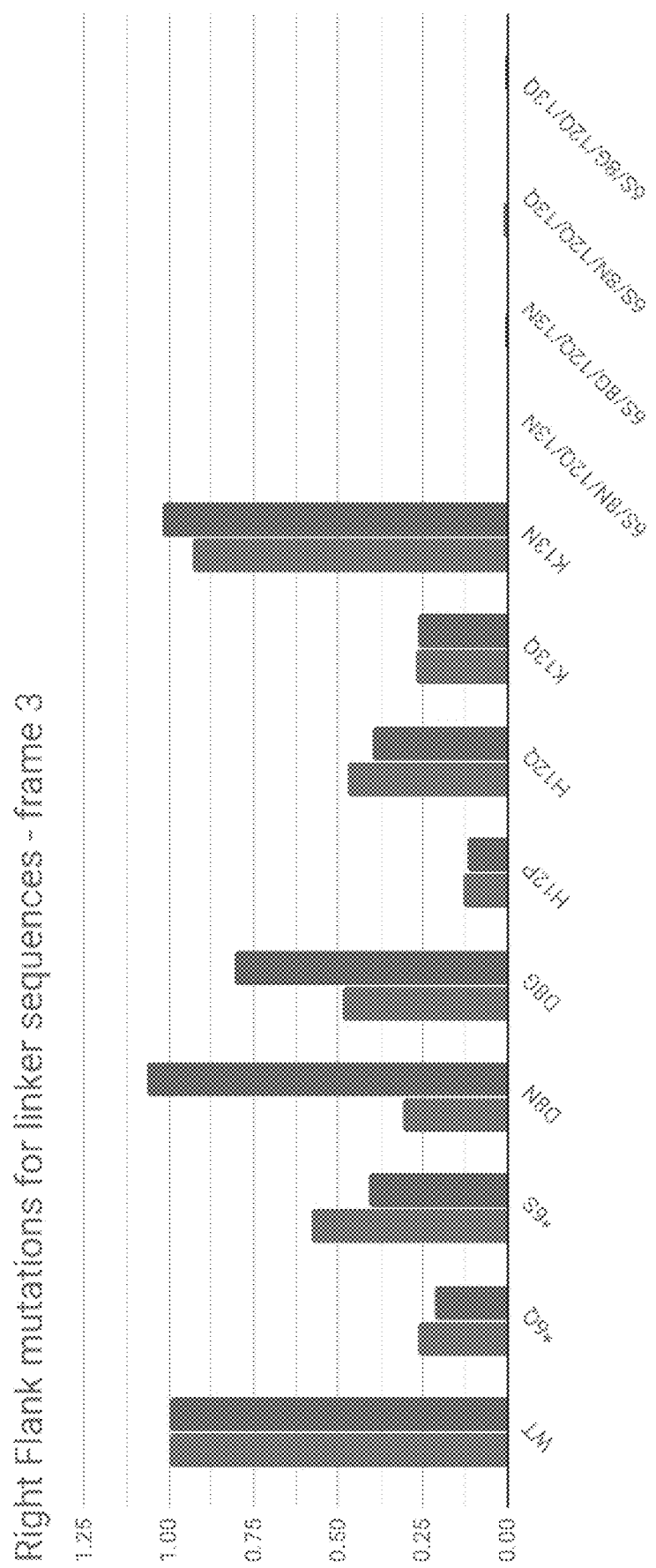
Figure 76:
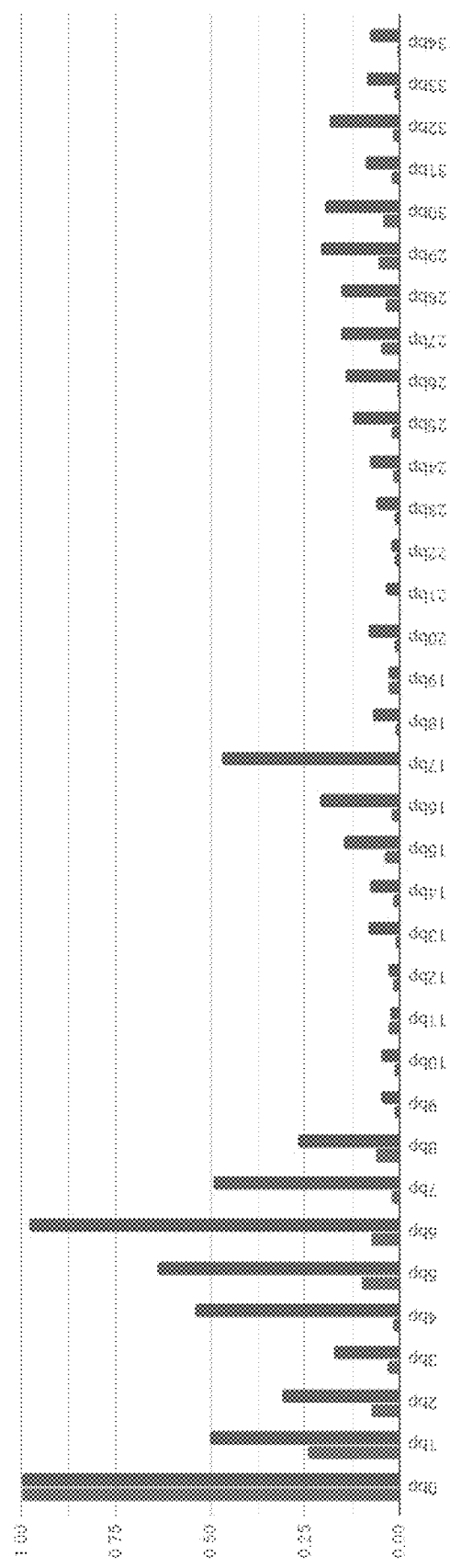
FIG. 76 is a graph of the relative integration efficiencies for members of the 'Right Flank Spacing' library (library f). The two different orientations in which the transposon can integrate are shown in blue (T-RL) and red (T-LR). The relative integration efficiency was calculated against variant END. 1.2.3. Library f) has variable spacing, from the terminal transposon right end, between the first and second TnsB binding site. The x-axis indicates the distance between the binding sites.
Figure 77A:
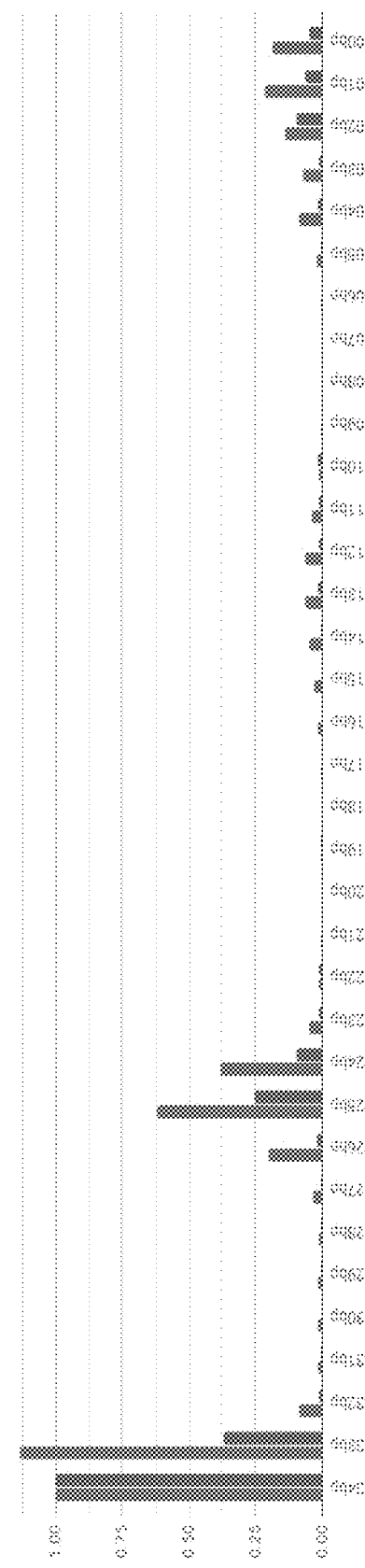
FIGS. 77A-77E are graphs of the relative integration efficiencies for members of the 'Left Flank Spacing' library (library g). The two different orientations in which the transposon can integrate are shown in blue (T-RL) and red (T-LR). The relative integration efficiency was calculated against an unmutated truncated (122 bp) version of the standard pDonor (expected to have an orientation bias of 0.60(T-RL):0.40(T-LR) based on truncation data published in Klompe et al., Nature 571, 219-225 (2019), incorporated herein by reference). Additionally, the Right Flank for all of these clones contains an MmeI recognition site which has a reduced integration efficiency of ~40% as compared to WT. The x-axis of each graph indicates what kind of mutation was present in that specific variant. If the change affected the distance in between the binding sites this is denoted as the number of base pairs that now constitute the spacing. If the change was in sequence identity the location of the affected bases is indicated (counting from the most terminal base within the spacing).
Figure 77B:
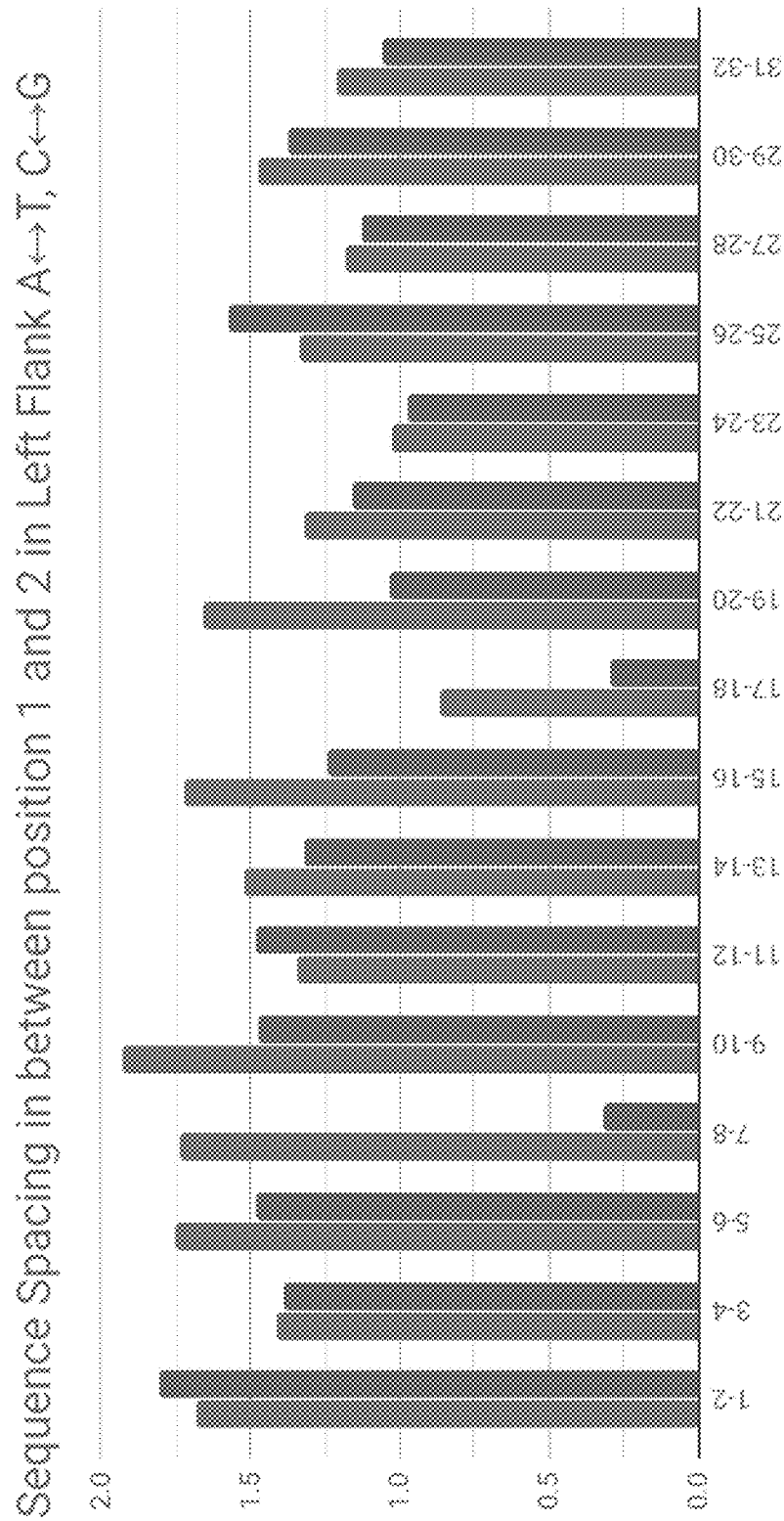
Figure 77C:
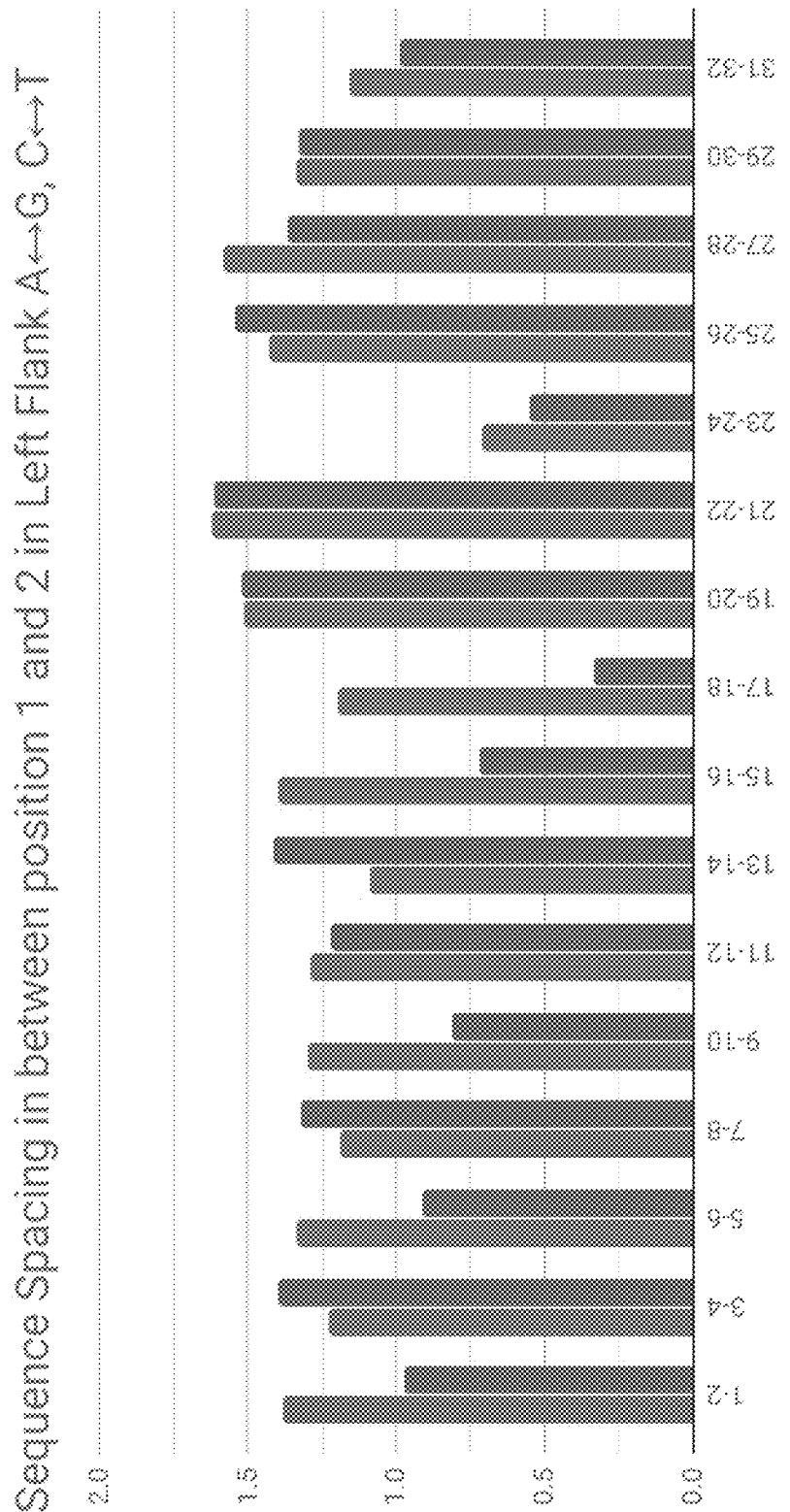
Figure 77D:
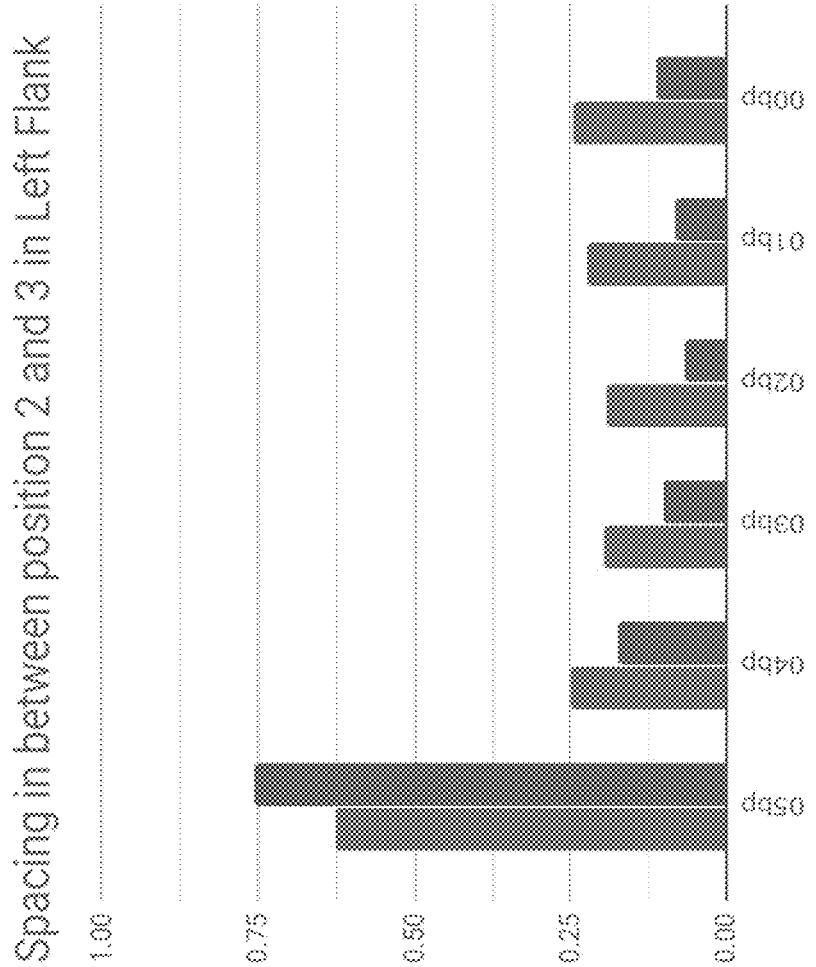
Figure 77E:
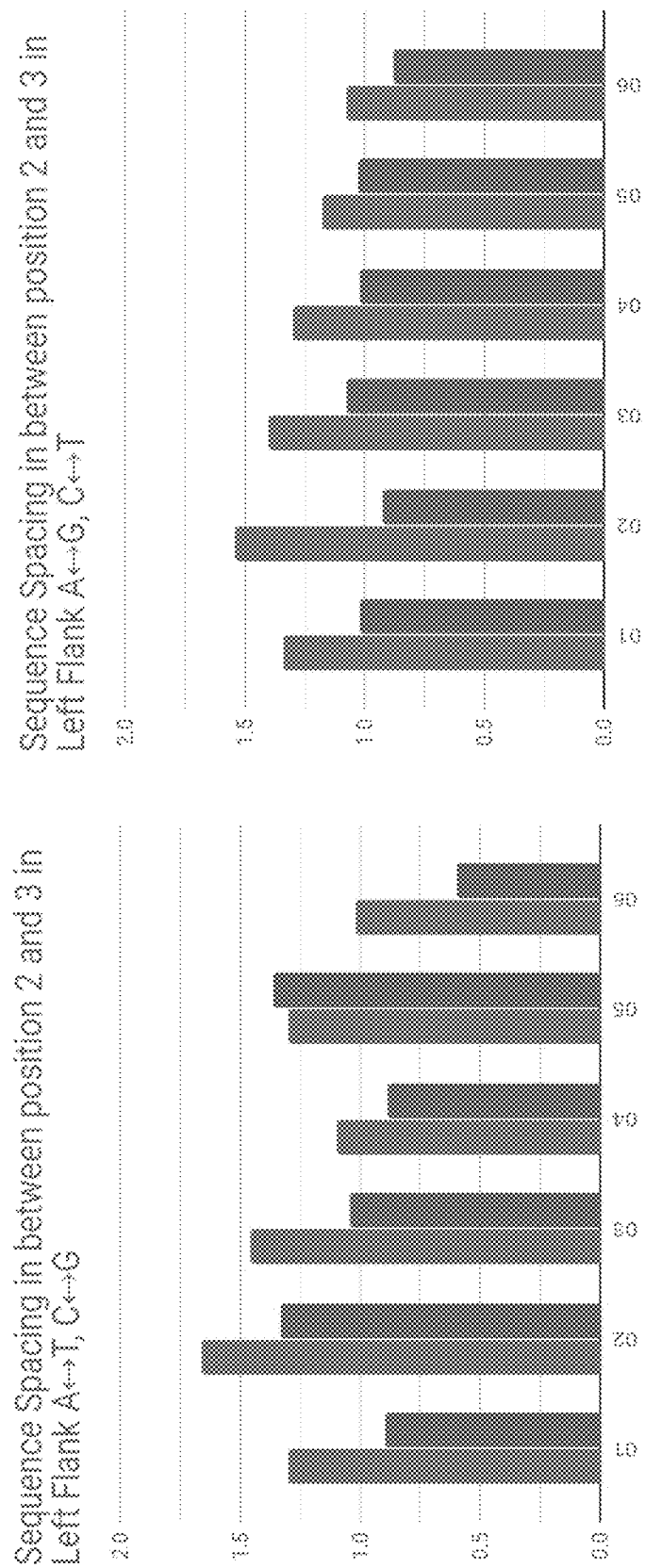

Library c) investigated the effect of 2-bp mutations that were tiled throughout the entirety of the transposon right end and revealed (FIG. 73) very interesting patterns in which residues allowed for efficient transposition. Mutations in the most inner TnsB binding site in the right transposon end increased transposition efficiency. Mutations on the most terminal and the middle TBSs showed very similar effects and demonstrated that the $7^{th}$-$10^{th}$ and $13^{th}$-$14^{th}$ bases of the TBS control efficient integration. In contrast to information available on the *E. coli* Tn7 transposon, the 8-bp terminal sequence appeared to be quite flexible to mutations with the exception of the most terminal 2-bp. Library d) explored the effect of 1-bp mutations within the terminal 8-bp of the transposon right end and validated (FIG. 74) the data from the 2-bp mutation panel, revealing high plasticity to mutations for the majority of sites in the 8-bp sequence. However, three of the variants appeared to be completely incapable of transposition Library e) investigated mutations to the right transposon end to replace stop codons with regular codons and to substitute codons encoding bulky/charged amino acids with codons encoding amino acids more suitable to function as a protein linker (FIGS. 75A-75C). Library f) and library g) examined the effect of changing the distance in between TBS (FIG. 76 and FIGS. 77A-77E, respectively). Changing nucleotide identities within these spacings appeared to be inconsequential, however, the proper distance in between the TBSs allowed efficient transposition. These data revealed surprising patterns at 10 bp intervals, suggesting the positioning of the TBSs on the three-dimensional structure of the double-stranded DNA helix may be important.

Example 12

Figure 78:
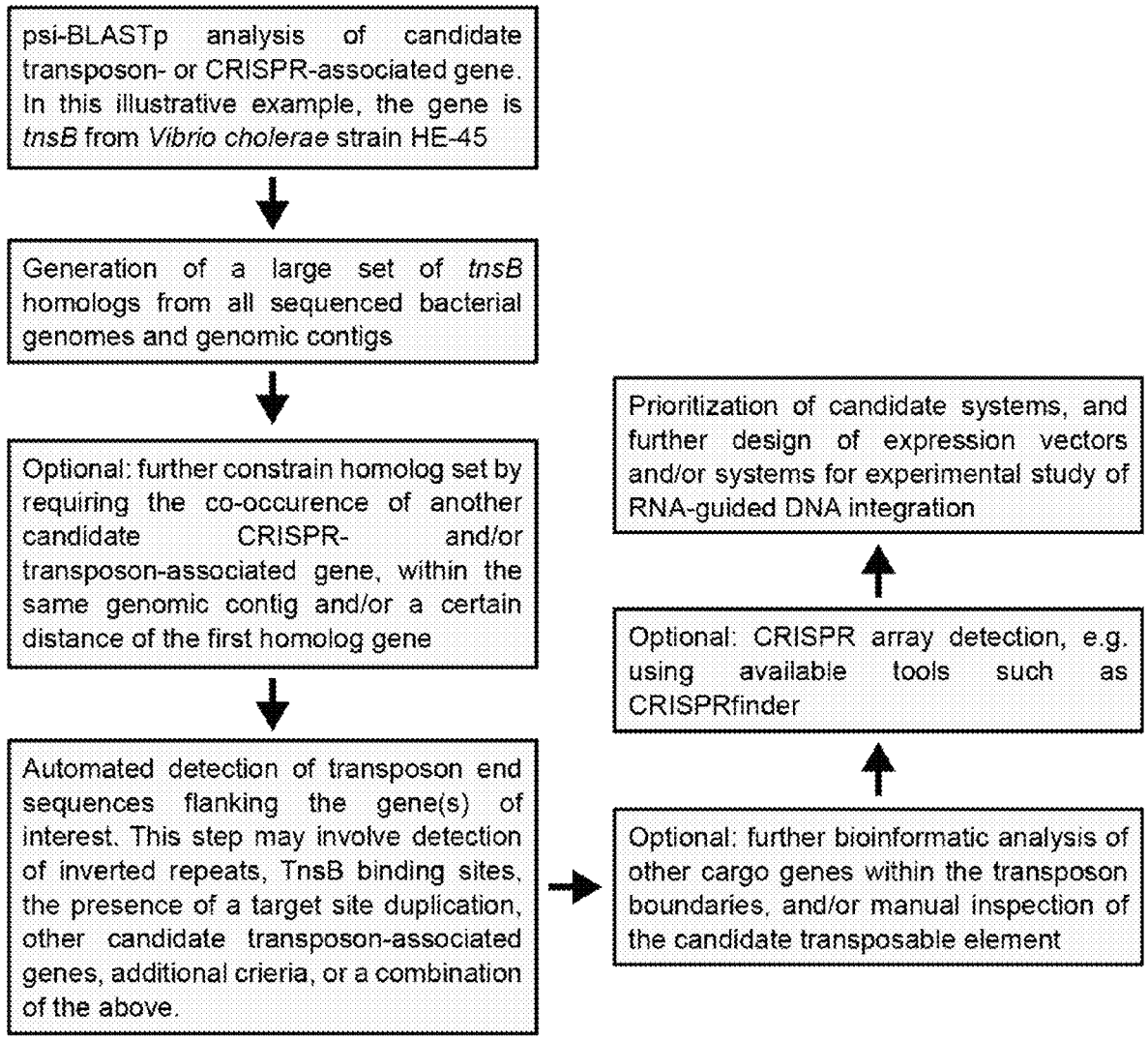
FIG. 78 is an exemplary flow chart for bioinformatics identification and selection of candidate CRISPR_transposon systems. Each box, in the order defined by the arrows, highlights the steps used to gather a large set of candidate CRISPR-transposon systems for experimental study. Certain steps are denoted as optional, and the entire pipeline may be gated based on various seed strategies. For example, in the exemplary flow chart shown, the entire search algorithm is seeded based on the tnsB gene. In other embodiments, the search is seeded based on other transposon-associated genes, based on CRISPR-associated genes, based on the CRISPR array itself, or based on the transposon end sequences.

Identification and Functional Testing of Additional CRISPR-Transposon Homologs Containing Type I-F Variant CRISPR-Cas Systems A computational and bioinformatics pipeline was developed to identify additional CRISPR-transposon systems. The pipeline may include the following steps (FIG. 78):

1. psi-BLASTp of a candidate transposon-associated gene, such as the tnsB gene, searching all sequenced and available bacterial genomes and genomic contigs, to identify other tnsB family members 2. Optionally performing a parallel psi-BLASTp with candidate CRISPR-associated (cas) genes specific to a particular CRISPR-Cas subtype, such that only those sequenced genomes and genomic contigs that contain co-occurrence of a nsB ortholog and candidate cas gene are analyzed. This co-occurrence may be further constrained based on the two genes being separate by less than a certain distance in primary sequence space. The cas gene may include from among the following, but is not limited to: cas12, cas9, cas8, ca7, cas6, cas5, csy1, csy3, csy2, and further subtype-specific variants of these cas gene families.

3. Automated detection of transposon boundary sequences flanking the tnsB gene. This detection step returns candidates pairs of transposon ends (left and right, L and R), flanking the tnsB gene. This transposon end detection algorithm may encompass from amongst the following heuristics:
   a. Detection of a direct repeat, constituting a target site duplication (TSD) from prior transposition event. The TSD may be 5 base pairs in length.
   b. Detection of a highly conserved terminal inverted repeat sequence. The terminal inverted repeat sequence may be 8 base pairs in length, and the inverted repeats within the candidate left (L) and right (R) transposon ends may be identical, or be imperfectly matching between the two ends.
   c. Detection of multiple inverted repeat elements, often considered to be TnsB binding sites based on homology to the well-studied Tn7 transposon from *E. coli*. These binding sites may be identified de novo (i.e. without any a priori sequence information), by sequence similarity to known TnsB binding sites (e.g. from *E. coli* Tn7, from *V. cholerae* Tn6677, or additional transposon sequences), by a combination of the two approaches, or by other heuristics.
   d. Detection of transposon end sequences within intergenic regions
   e. The presence of additional gene homologs of other known or expected components of Tn7- or Tn5053-like transposons, including insA, insC, tniQ, other variants of these genes, or other transposon-associated genes 4. In the case of multiple candidate transposon ends, additional manual inspection may be employed to further prioritize or collate the candidate set of transposon end pairs.

5. Bioinformatic analysis of the other genes found within the candidate transposon, based on HHpred analysis or other similar analytical approaches 6. CRISPR array detection using available CRISPRfinder tools (e.g. CRISPRCasFINDER, accessible online through CRISPR-Cas++), or custom CRISPR array detection algorithms Bioinformatic Identification of CRISPR-Transposon Systems with Intact I-F Variant CRISPR-Cas Systems Using the pipeline described above, all genome and genomic contig sequences from NCBI that contained the co-occurrence of the following gene families: InsA, insB, tnsC, IniQ, cas8, cas7, and cas6 were extracted. These bioinformatics searches were seeded with gene orthologs derived from the *V. cholerae* Tn6677 transposon. A phylogenetic tree was constructed using tsB homology, and the candidate tnsB genes/proteins were further grouped into different "phylo groups" encompassing discrete clades. After performing transposon end detection as outlined above, CRISPR-transposon systems were identified.

Figure 79:
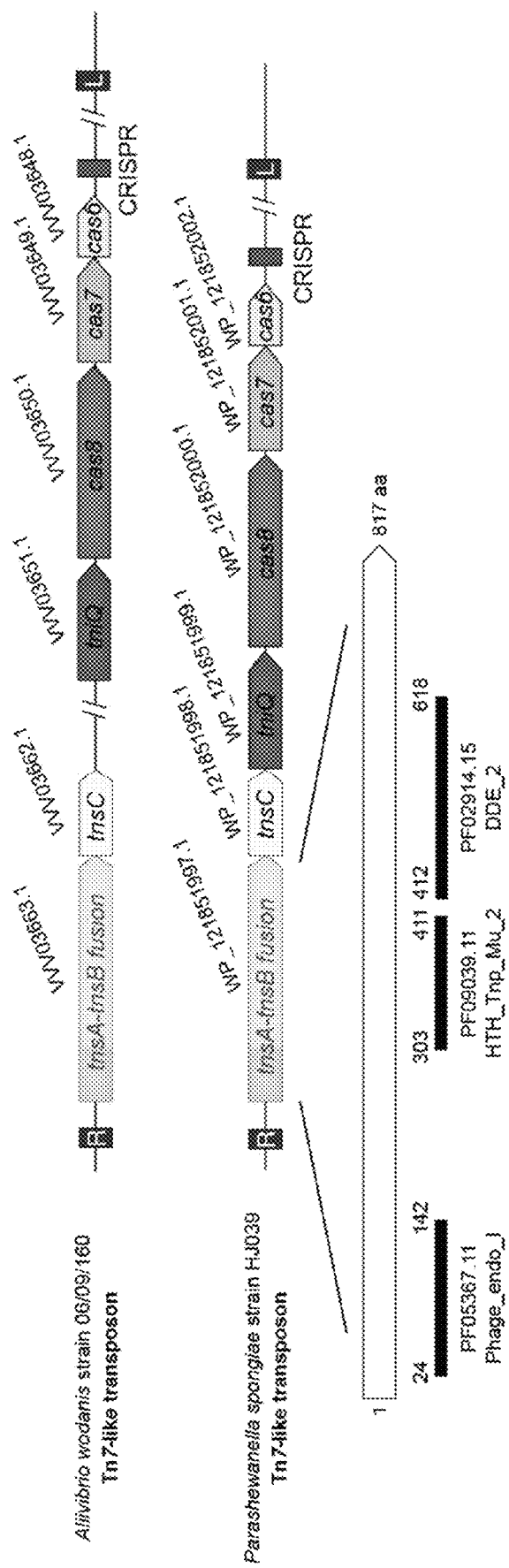
FIG. 79 shows the bioinformatic identification of CRISPR-transposon systems with a Type I-F variant CRISPR-Cas system, in which tnsA and tnsB are fused. The two indicated species contain CRISPR-transposon systems, in which the tnsA and tnsB genes are found in a natural fusion gene. The arrangement of the remaining components necessary for RNA-guided DNA integration are shown, as well as the NCBI protein accession IDs. For the tnsA-tnsB gene from *Parashewanella spongiae* strain HJ039, HHpred analysis confirmed the presence of hallmark Pfams for both TnsA (PF05367.11) and TnsB (PF09039.11 and PF02914.15).

Bioinformatic Identification of CRISPR-Transposon Systems with Intact I-F Variant CRISPR-Cas Systems, Containing Natural tnsA-tnsB Fusions Separately, a psi-BLASTp search was seeded with an artificial fusion of the nsA and tnsB genes from *V. cholerae* Tn6677, in order to look for closely related homologs that contain natural tnsA-tnsB fusions. Such natural fusion homologs could be readily identified, as confirmed by HHpred analysis of candidate tnsA-tnsB fusion genes (FIG. 79), and these fusion genes co-occurred with type I-F variant CRISPR-Cas systems.

Design of Expression Plasmids and Mini-Transposon Donor DNA Plasmids for New Candidate CRISPR-Transposon Systems The molecular machinery derived from the VI *cholerae* Tn6677 transposon robustly catalyzed RNA-guided DNA integration in an *E. coli* expression host, when the CRISPR RNA (crRNA, also known as the guide RNA, or gRNA) and all 7 protein-coding genes were expressed from a single upstream T7 promoter, as discussed above. A representative single-expression effector plasmid encoding such a system is typified by pSL1022 (SEQ ID NO: 855), which targets lacZ for DNA integration using crRNA-4. The single-expression effector plasmid expressing all the protein and RNA components was combined with a pDonor plasmid encoding the mini-transposon, in which an arbitrary genetic cargo was flanked by the identified left (L) and right (R) ends of the transposon. The single-expression effector plasmid in this embodiment was cloned onto a pCDFDuet-1 derivative vector, and the mini-transposon donor DNA was cloned onto a pUC19 derivative vector.

Figure 81:
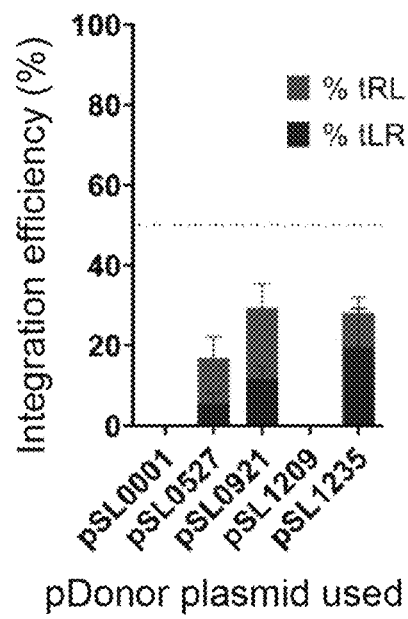
FIG. 81 is a graph of the RNA-guided DNA integration data for modified pDonor vector backbones. Integration efficiencies were determined by qPCR for pDonor derivatives, using the CRISPR-transposon system from *Vibrio cholerae* strain HE-45. Relative to pSL0527 (SEQ ID NO: 7), pSL0921 (SEQ ID NO: 1613) had a deletion in the extraneous lac promoter, and pSL1235 (SEQ ID NO: 1614) had additional extraneous sequences removed. pSL0001 (SEQ ID NO: 5) is an empty vector control equivalent to pUC19, and pSL1209 (SEQ ID NO: 1612) is an empty vector control but with similar extraneous sequences removed as are also absent in pSL1235. Plotted are the integration efficiencies for both the tRL and tLR orientations, shown in red and blue, respectively. The pSL0921 and pSL1235 donor plasmids show slightly high integration efficiency than pSL0527, and thus, pSL1235 was the design that served as the benchmark for pDonor vectors for other homologous CRISPR-transposon systems.

Single-expression effector plasmids, and associated mini-transposon donor DNA plasmids, were designed and synthesized for 14 new candidate CRISPR-transposon systems, based on the validated design from the *V. cholerae* Tn6677 system (FIG. 80). The single-expression effector plasmids were designed to use the same exact 32-nucleotide spacer sequence as crRNA-4 from the *V. cholerae* system, targeting lacZ adjacent to a 5'-CC-3' protospacer adjacent motif (PAM), and the pDonor plasmids were designed to mobilize the same chloramphenicol resistance gene (CmR) as was used in previous experiments with the *V. cholerae*. pDonor designs employed herein relied on a slightly new vector design previously tested with the *V. cholerae* system, in which the lacZ-alpha fragment and promoter-operator elements near the multiple cloning site (MCS) were removed. RNA-guided DNA integration with these new pDonor designs (e.g. encoded by pSL0921 and pSL1235; SEQ ID NOs: 1613 and 1614, respectively) showed slightly higher integration efficiencies in *E. coli*, as compared to an earlier pDonor design (encoded by pSL0527, SEQ ID NO: 7), when tested in parallel (FIG. 81).

A list of the 8 CRISPR-transposon systems, as well as the plasmid identifiers for the single-expression effector plasmid, and the mini-transposon donor DNA plasmid, can be found in FIG. 80B. The complete sequences of all the plasmids can be found SEQ ID NOs: 1612-1630 and 1897-1908. The sequence of genes, proteins, CRISPR repeats, and transposon ends for each homologous CRISPR-transposon system can be found in SEQ ID NOs: 1768-1896 and 1909-2000.

For Photobacterium *ganghwense* strain JCM 12487, the naturally occurring tnsB gene is split into two separate open reading frames (ORFs) that are annotated in NCBI as two separate protein accession IDs, WP_053061936.1 and WP_053061935.1. Upon closer inspection of this gene arrangement, a potential frameshifting sequence was identified directly at the junction of these two ORFs, and further alignments confirmed that both separate ORFs encode a protein that is present in other homologous systems as a single contiguous ORF and TnsB protein. Therefore, to avoid any requirement for frameshifting, or the potential for truncated TnsB protein expression, the coding sequence was engineered to eliminate the polyA frameshifting hotspot, and a single C was inserted, in order to generate a full-length insB gene containing a single contiguous ORF. This sequence can be found in the final single-expression effector plasmid sequence for the CRISPR-transposon system from Photobacterium *ganghwense* strain JCM 12487 (pSL1785, SEQ ID NO: 1627).

CRISPR-transposon systems selected from *Aliivibrio wodanis* 06/09/160 and *Parashewanella spongiae* strain HJ039 contain natural occurring fusions between the tnsA and tnsB genes, which was readily detectable by domain assignment by HHpred. These systems were designed and tested in engineered vectors containing the TnsA-TnsB fusion.

Experimental Testing of RNA-Guided DNA Integration with New Candidate CRISPR-Transposon Systems 14 CRISPR-transposon systems were tested for RNA-guided DNA integration in an *E. coli* expression system according to the prior work with the CRISPR-transposon system from *Vibrio cholerae* strain HE-45, derived from Tn6677. Chemically competent BL21(DE3) cells were first transformed with the pDonor plasmid, cells were plated on LB-agar plates containing carbenicillin, and individual colonies were picked to inoculate overnight cultures. These cultures were then made chemically competent, and then transformed with the cognate single-expression effector plasmid, also known as pCQT (where CQT denotes the order of modules on the vector: C=CRISPR array, Q=TniQ-Cas8-Cas7-Cas6 operon, and T=TnsA-TnsB-TnsC operon). In each case, the pDonor vector contained the transposon ends derived from the same CRISPR-transposon system for which the matching pCQT encoded the associated CRISPR- and transposon-associated factors. Cells were plated LB-agar plates containing both carbenicillin and spectinomycin, as well as 0.1 mM IPTG to induce expression of the protein and RNA components encoded on pCQT.

After an overnight growth on solid media, colonies were scraped from the plate and subjected to PCR analysis. PCR primers were chosen, in which one primer had a complementary binding site within the transposon donor DNA common to all pDonor plasmids (residing within the CmR antibiotic resistance gene), and the second primer had a complementary binding site within the lacZ sequence in genomic DNA. Primer pairs were chosen that would amplify either a product of integration in the target-right-left orientation (tRL(T-RL)), or a product of integration in the target-left-right orientation (tLR (T-LR)); products may also be present for both orientations, because dozens to hundreds of colonies are analyzed as a pooled mixture in this experiment, and thus there are heterogeneous genomes present in the same mixture. Specifically, PCR reactions to amplify tRL products utilized primers oSL1164 (5'-CGCCGCACATCT-GAACTTC-3' SEQ ID NO: 353) and oSL0763 (5'-GTGGT-ATTCACTCCAGAGCG-3' SEQ ID NO: 343). PCR reactions to amplify tLR products utilized primers oSL1179 (5'-CTGAACTTCAGCCTCCAGTAC-3' SEQ ID NO: 1765) and oSL1656 (5'-CCATGTCGGCAGAATGCTTA-3' SEQ ID NO: 1766).

Figure 82A:
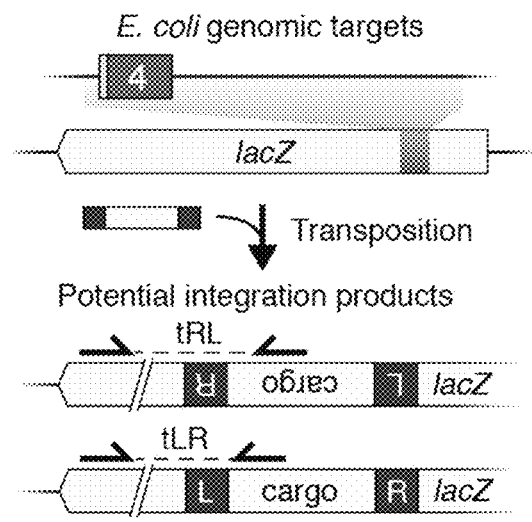
FIGS. 82A-82C show the PCR detection of RNA-guided DNA integration products from transposition assays using homologous CRISPR-transposon systems.
Figure 82B:
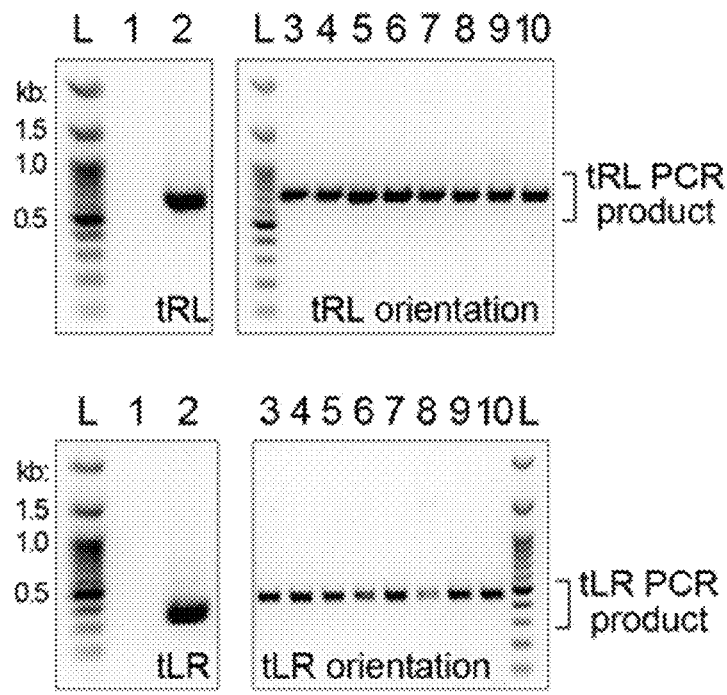
Figure 82C:
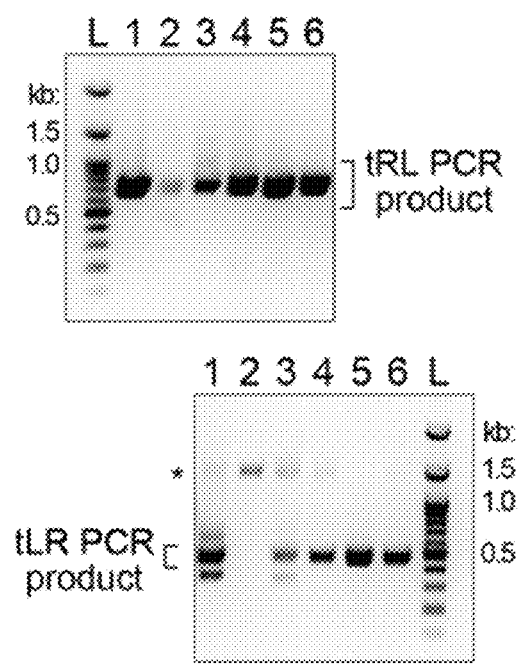

In the presence of a bona fide integration event, the combined primers yield a PCR product of ~700 base pairs for tRL and ~500 base pairs for tLR. As shown in FIG. 82, robust RNA-guided DNA integration was observed for all 14 CRISPR-transposon homologs containing I-F variant CRISPR-Cas systems, as well as for the positive control containing the system derived from Vibrio cholerae strain HE-45; no products were observed for a negative control, in which pSL1022 (pCQT for V. cholerae strain HE-45) was combined with an empty vector control in place of pDonor. The tested systems showed integration in both the tLR and tRL orientations. qPCR or next-generation sequencing is used to determine the quantitative difference in integration orientation, and integration efficiency, across many distinct target sites.

To further confirm that the observed PCR products were indicative of bona fide RNA-guided transposition, i.e. RNA-guided DNA integration, select product bands were excised from the gel, purified using a QIAquick gel kit, and submitted for Sanger sequencing analysis. For the PCR products resulting from primer pairs intended to amplify the tRL products, the bands were sequenced with either the primer specific to CmR within the donor DNA (effectively sequencing outwards towards the transposon-genome junction), or with a lacZ genome-specific primer, effectively sequence inwards towards the genome-transposon junction. For the PCR products resulting from primer pairs intended to amplify the tLR products, only the bands with a primer specific to CmR within the donor DNA (effectively sequencing outwards towards the transposon-genome junction) were sequenced. Sanger sequencing conclusively verified all the expected transposition products, and in all cases, revealed an insertion site that was 47-51 bp downstream of the target site complementary to the spacer sequence for crRNA-4. As previously documented, insertion sites can be slightly variable across a population of cells, and thus, for cell populations in which there is more heterogeneity in the insertion site choice, this manifests itself in Sanger sequencing data as mixed peaks immediately as the sequencing reaction proceeds past the transposon-genome junction. This feature was readily observable for some systems in this lacZ-targeting experiment, such as the system derived from Vibrio cholerae strain 4874. These mixed peaks often result in the appearance of apparent disagreement between the sequence past the genome-transposon junction and the reference sequence, however may be attributed to this integration site heterogeneity across the population of genomes being tested in the experiment, as demonstrated previously. In contrast, other systems, such as that derived from Pseudoalteromonas sp. P1-25, the absence of extensive heterogeneity in the peaks, past the transposon-genome junction, indicated that these systems exhibited a more precise and homogeneous insertion site selection.

Example 13

Figures 83A, 83B:
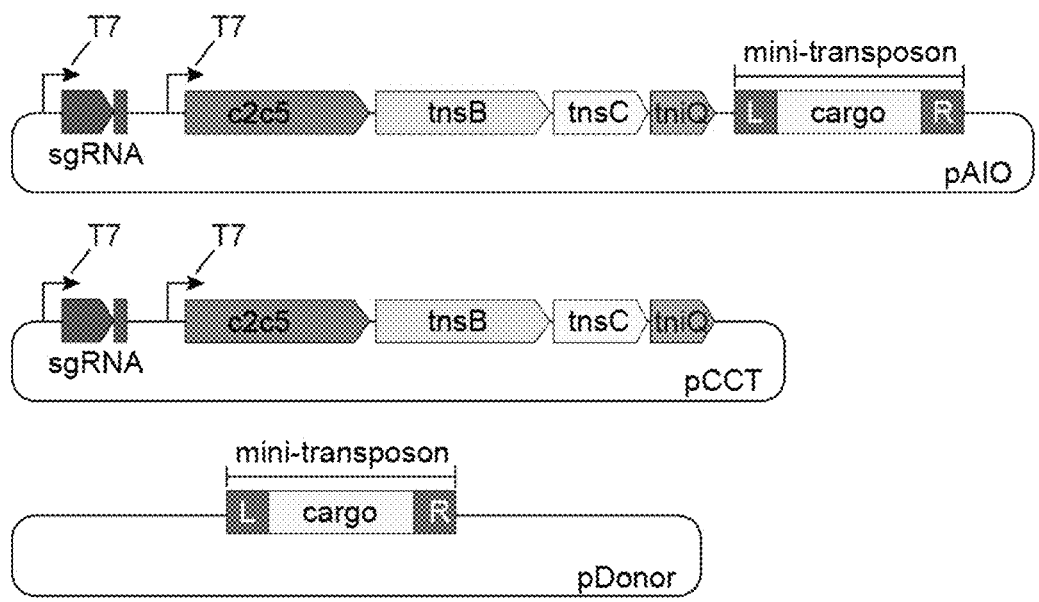
FIGS. 83A and 83B shows the vector layout for testing RNA-guided DNA integration with Type-V CRISPR-Cas system associated transposons.
Figure 85A:
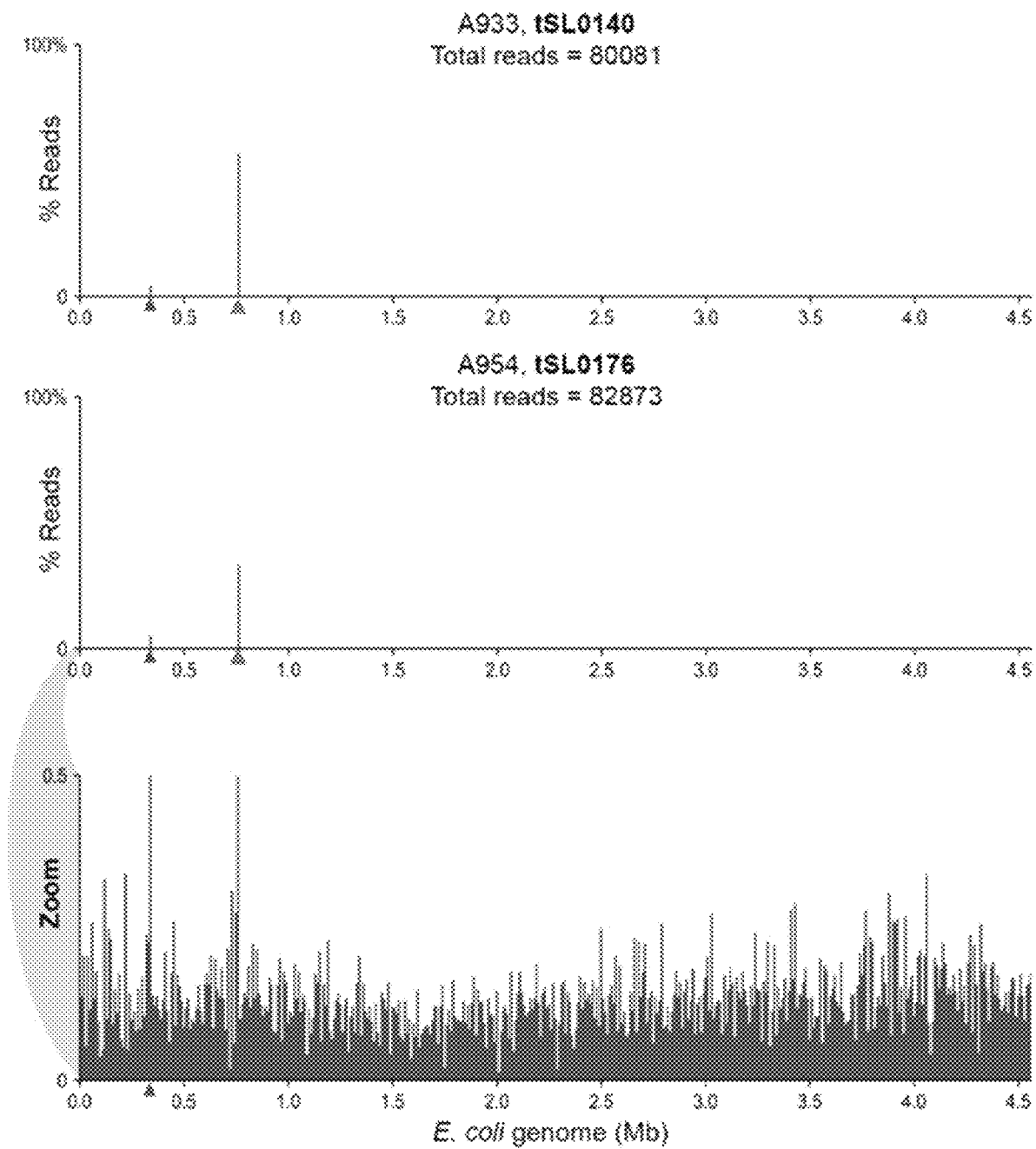
FIGS. 85A-85C are genome wide specificity of three different CRISPR-transposon systems, two Type V (FIGS. 85A and 85B) and one Type I (FIG. 85C) associated systems. Two different guides were tested for each of the systems (top and middle rows), indicated by the tSL # at the top of each plot. The corresponding target site is shown as a maroon triangle on the x-axis. The percent of reads mapping to the on-target site is shown in red next to the peaks when possible. For each system we zoomed in on the y-axis to 0.5% of reads (bottom row). The on-target specificities are given in red bolded text.
Figure 85B:
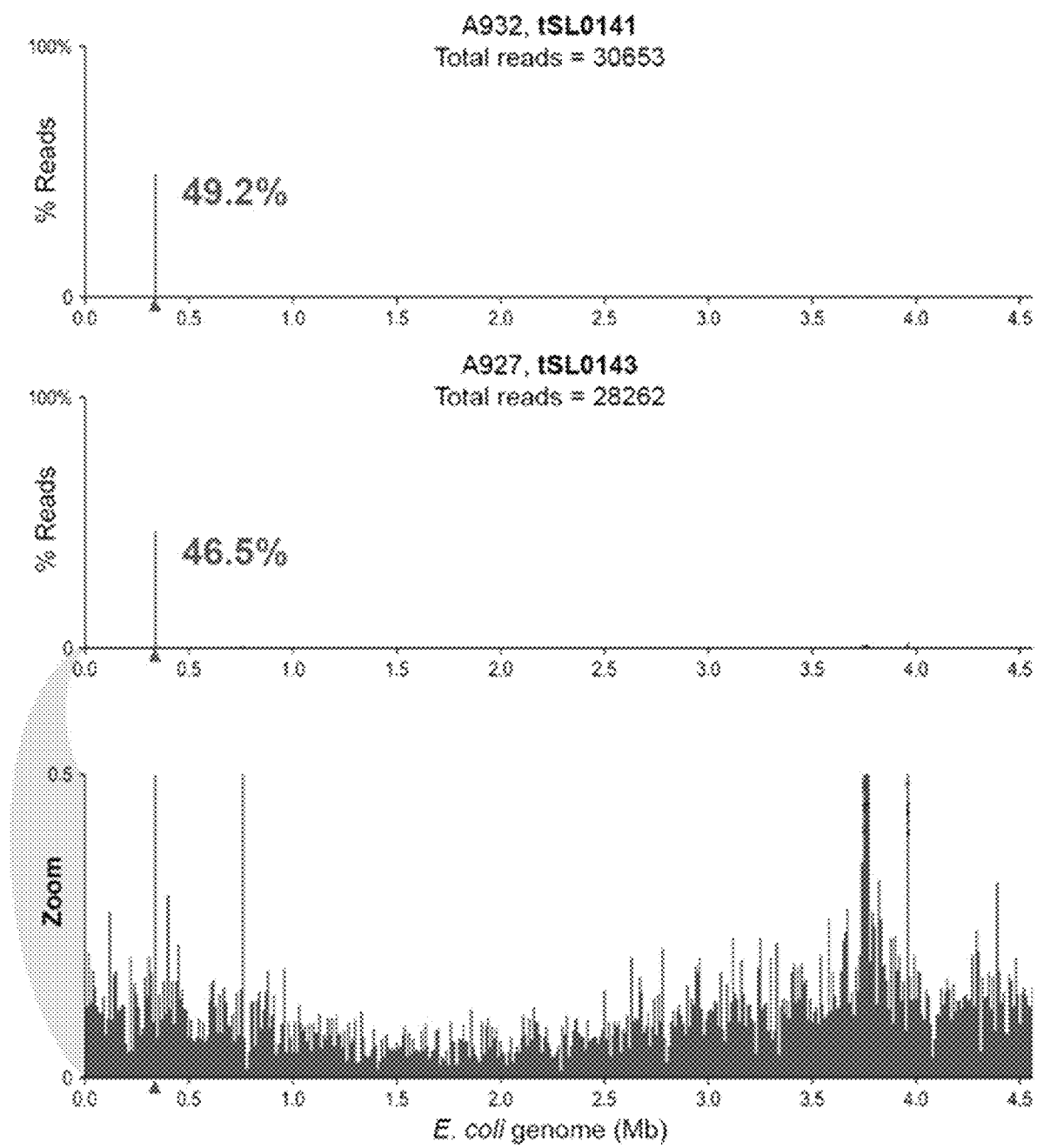
Figure 85C:
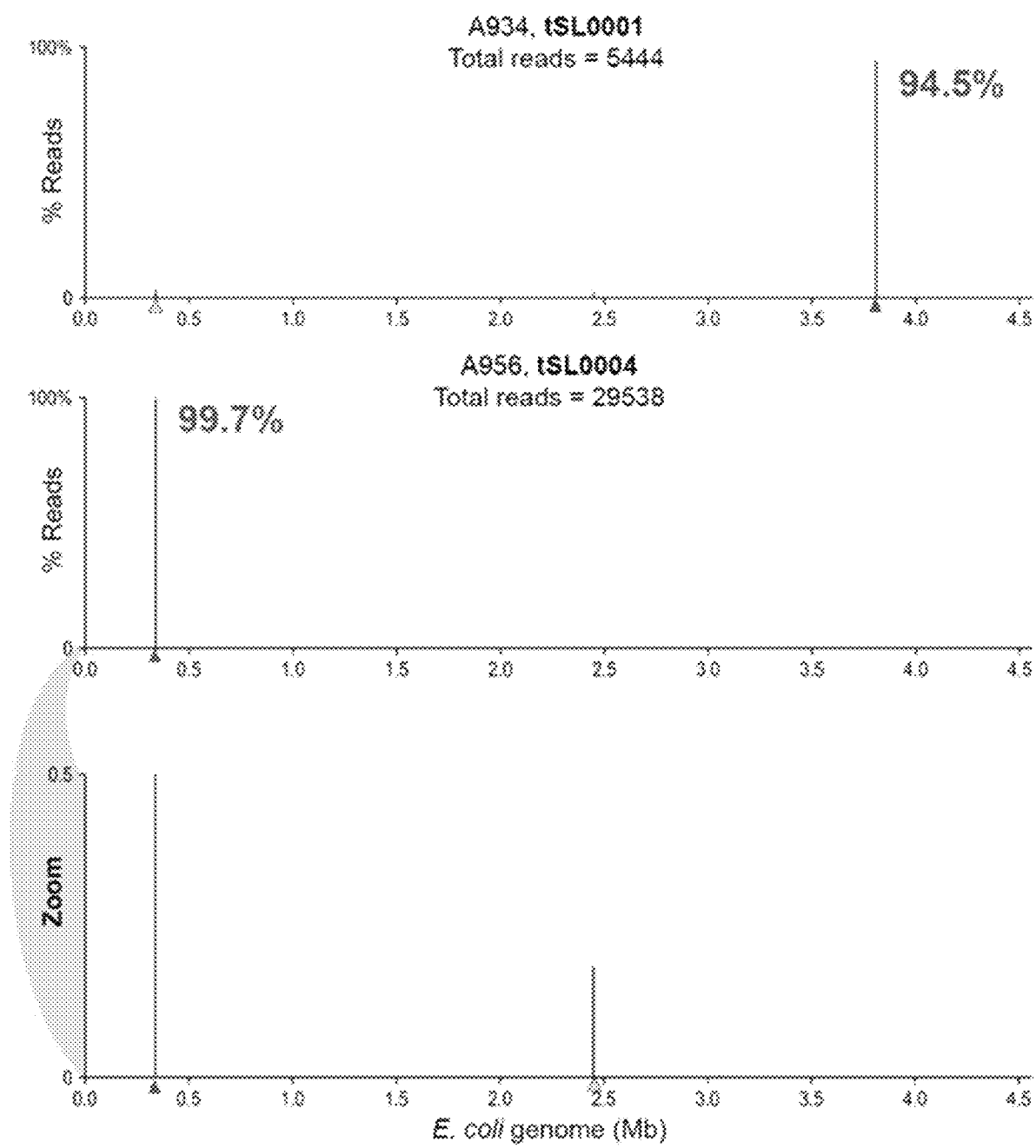

Identification and Functional Testing of Additional CRISPR-Transposon Homologs Containing Type V CRISPR-Cas Systems A CRISPR-associated transposon from *Scytonema hofmannii* strain PCC 7110 that uses a Type V CRISPR-Cas system (referred to herein as Sho-INTEGRATE or ShoINT) was characterized. Using vector designs similar to the ones used in the above work (FIG. 83), RNA-guided DNA integration was shown by PCR and qPCR (FIG. 84). A random fragmentation sequencing method was also adopted to reveal genome wide specificity (FIG. 85) of this system as well as of two previously published CRISPR-transposon systems: a type V system published by Strecker et al. (Nature Communications 10, 212 (2019), incorporated herein by reference, and referred to herein as ShCAST), and the type I system described above from *V. cholerae* (published in Klompe et al., Nature 571, 219-225 (2019), incorporated herein by reference, and referred to herein as Vch-INTEGRATE or VchINT).

Protocol for Testing RNA-Guided DNA Integration Activity

Sequence information for plasmids used can be found in SEQ ID NOs: 1631-1633, 1641, and 1643-1644. The sequences of the individual genes, CRISPR repeats, proteins, and mini-transposons for using this Type V variant can be found in SEQ ID NOs: 422-425, 437-449, and 1648-1650

BL21(DE3) *E. coli* cells were co-transformed with pDonor (pSL0948, SEQ ID NO: 1631) and pCCT (pSL1114 (SEQ ID NO: 1632) or derivative). Transformations were plated on agar plates containing spectinomycin/carbenicillin, and incubated at 37° C. The next morning colonies were resuspended in LB and spread on agar plates containing spectinomycin/carbenicillin/IPTG (0.1 mM) and again incubated at 37° C. After 24 h the colonies were resuspended in LB, OD measurements were made, and normalized amounts were transferred to new tubes. The aliquots were spun down and resuspended in water. Samples were then boiled at 95° C. for 10 min, after which the samples are spun down and dilutions are made for the supernatant for downstream analyses.

Integration events at the genomic target site were amplified by 30 cycles of PCR using a transposon- and genome-specific primer. PCR reactions were analyzed using agarose gel electrophoresis.

Quantification of integration events was done using qPCR with a transposon- and genome-specific primer and SsoAdvanced™ Universal SYBR® Green Supermix (BioRad).

Random fragmentation was performed on genomic DNA (isolated with the 'Wizard Genomic DNA Purification' kit from Promega) for 14 min using NEBNext® dsDNA Fragmentase® (New England Biolabs). The fragmented DNA was purified and size selected using Mag-Bind® Total Pure NGS magnetic beads (Omega). All subsequent steps followed the exact protocol as described for the NEBNext® Ultra™ II DNA library Prep Kit for Illumina® (New England Biolabs). An extra step was added to selectively amplify fragments that contained the transposon sequence by using a transposon specific primer in combination with a primer against the universal adapter. After this the individual samples were barcoded by 10 PCR cycles and Illumina's PCR2 index primers. Libraries were pooled, quantified using the NEBNext Library Quant Kit (New England Biolabs), and run on a mid-output Illumina NextSeq. Custom python scripts available on GitHub under 'Sternberg Lab at Columbia University' were used to analyze the data.

A CRISPR-transposon that can mobilize using a type V CRISPR-Cas system for target site selection was characterized. This system preferred to integrate with the left transposon end closest to the target site, an orientation referred to herein as tLR or T-LR. Integration efficiencies differ per guide RNA but are generally between 30-40%. The vectors were streamlined so that all the components are present on a single plasmid. Deep sequencing revealed a much higher specificity for VchINT, the type I system, than for both of the type V systems. Additionally, it showed that each system had a different pattern regarding the distance of the integration site from the target site, as ShoINT consistently integrated ~28 bp away, ShoCAST preferred distances of ~40 bp, and VchINT was primarily found ~49 bp counting from the 3' end of the target sequence.

Example 14

Figure 86A:
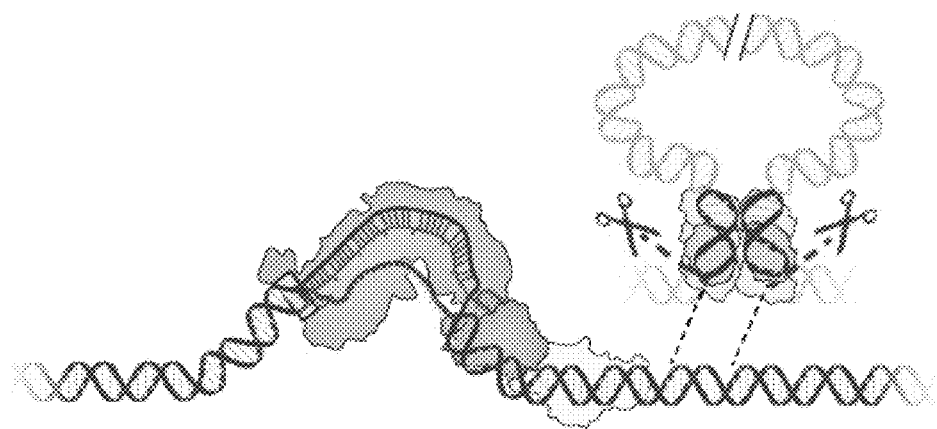
FIGS. 86A-86G show an overview of engineered vector designs to streamline expression and reconstitution of RNA-guided DNA integration.
Figure 86B:
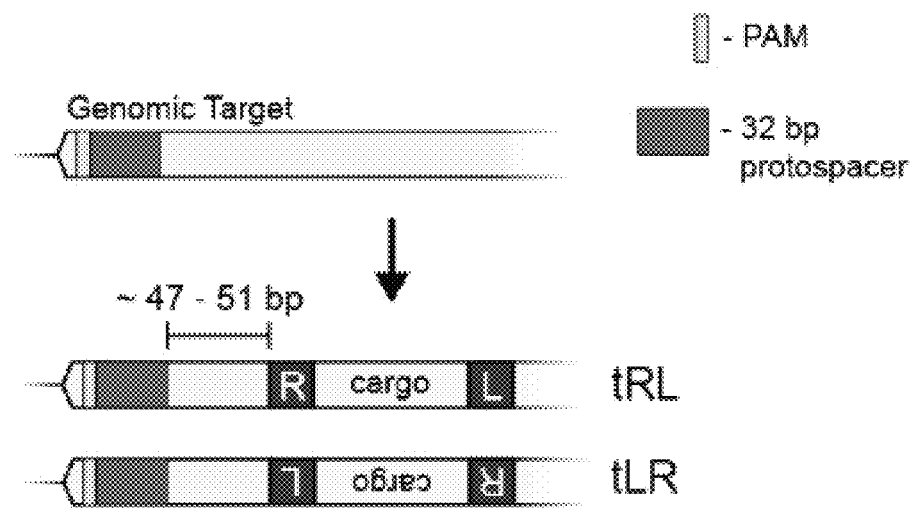
Figure 86C:
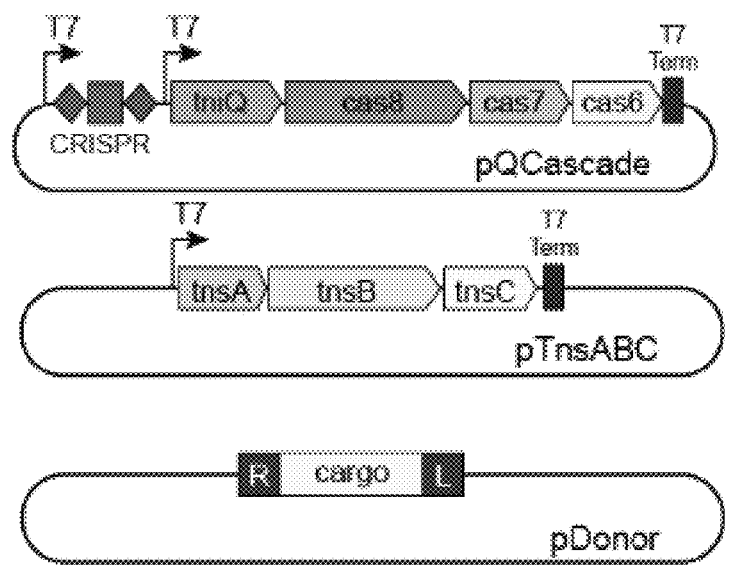
Figure 86D:
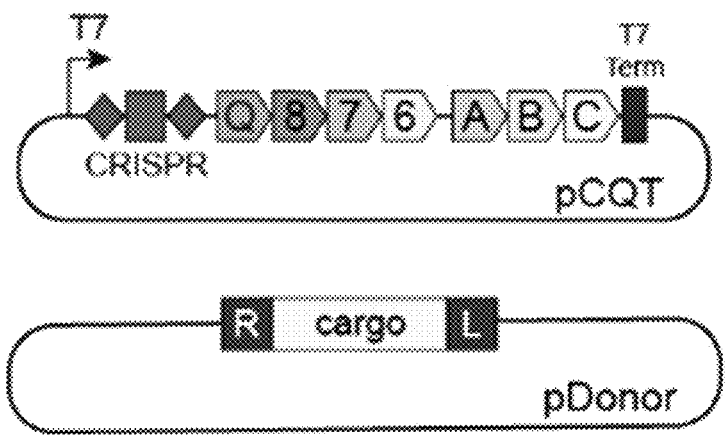
Figure 86E:
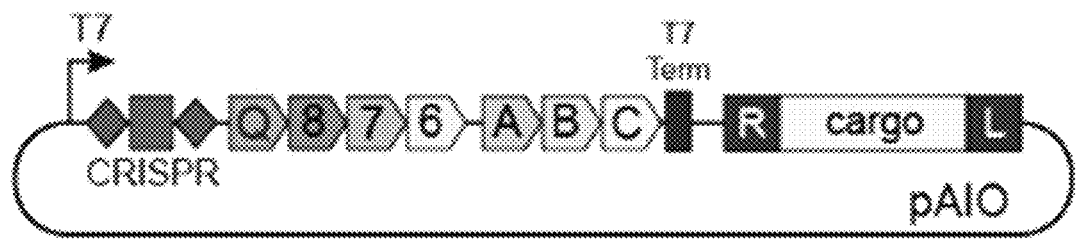
Figure 86F:
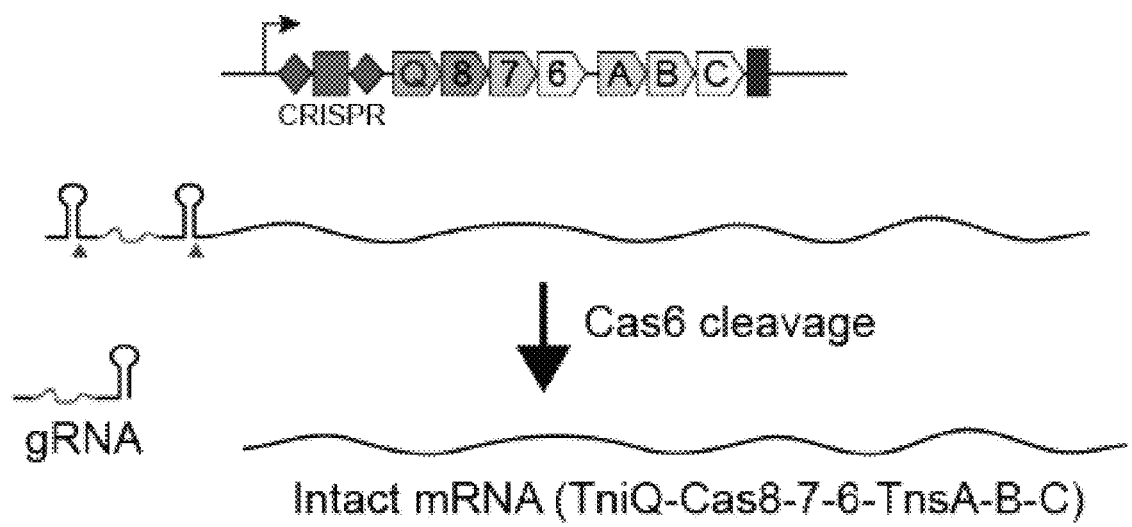

Development of CRISPR RNA-Guided Integrases for High-Efficiency, Multiplexed Bacterial Genome Engineering Described above are Tn7-like transposases associated with CRISPR-Cas systems, which mediate highly efficient RNA-guided DNA insertion (FIGS. 86A-86D). Herein, a streamlined system was developed and optimized to be capable of making accurate insertions at >90% efficiency while being expressed from a single transformable plasmid (FIG. 86E). Multiplexed crRNA arrays were incorporated to make multiple simultaneous insertions without significant hits to efficiency and specificity (FIG. 94). Because the proposed mechanism of transposition is self-contained and requires minimal host factors, transposition did not rely on common *E. coli* recombination pathway factors, and application of the system was translated to other species of interest.

Single-Plasmid RNA-Guided DNA Integration (INTEGRATE) Constructs Allow for Efficient and Precise RNA-Guided DNA Integration The initial expression approach for the transposon cargo sequence, crRNA and seven functional proteins involved 3 separate plasmids (FIG. 86C): pQCascade expressing the crRNA as well as the four proteins forming the Q-Cascade native operon, pTnsABC expressing the TnsABC native operon, and pDonor containing the cargo.

Figure 86G:
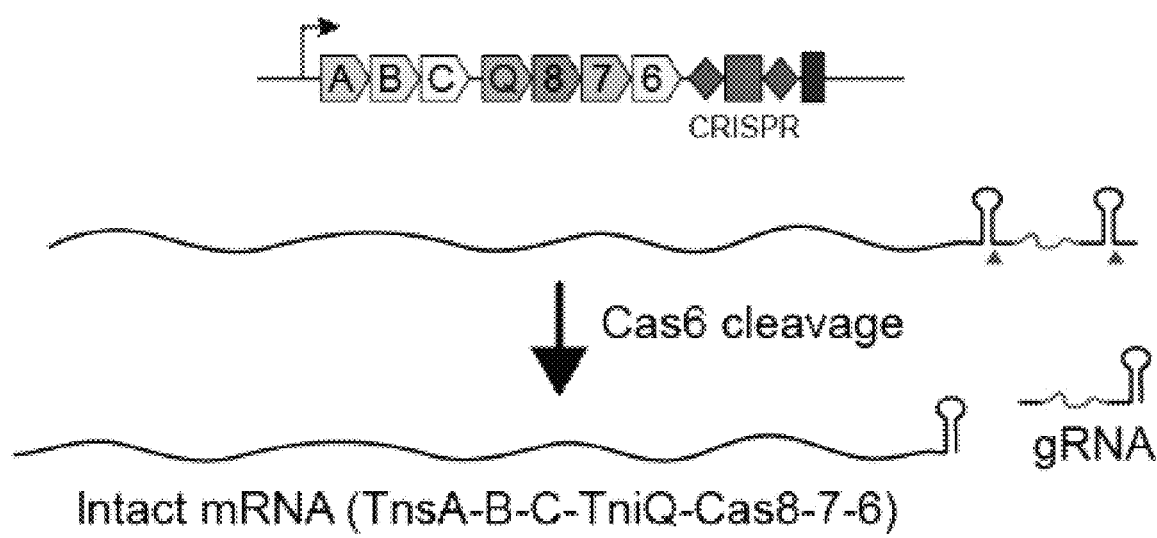

Starting from this 3-plasmid approach, several plasmid designs combining individual RNA-guided DNA integration components (FIGS. 86 D and 86E) were systematically cloned and benchmarked by qPCR. This led to an effector plasmid design pCQT, where a single lac-inducible T7 promoter drives expression of the transcript containing the crRNA array, followed by the QCascade-TnsABC fusion operon (FIG. 86G).

Figure 88A:
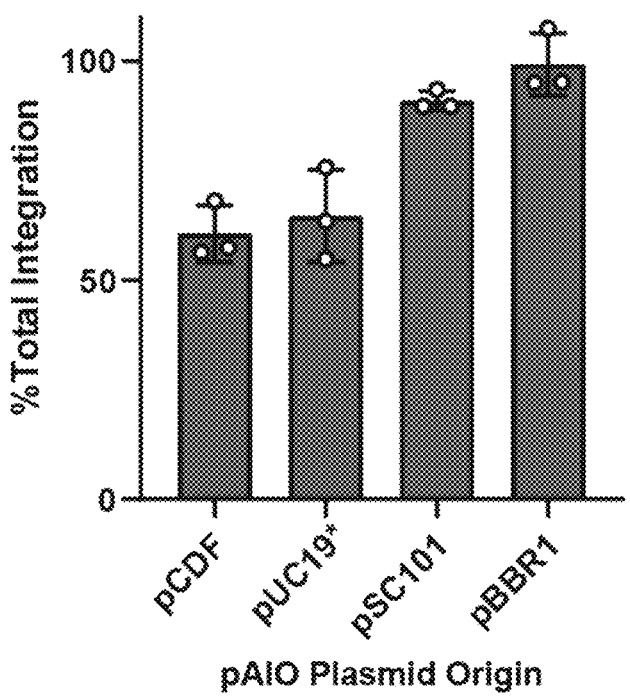
FIG. 88A-88C is graphs of the analysis of integration efficiencies with variable vector backbones and specific gRNAs. Derivatives of the all-in-one pAIO vector were cloned, in which the exact same construct was swapped into multiple distinct vector backbones, including pCDF, pUC19, pSC101, and pBBR1. The vectors have different antibiotic resistances, and importantly, different steady-state copy numbers. BL21(DE3) cells were transformed with each vector, and RNA-guided DNA integration efficiency was quantified by qPCR (FIG. 88A). The data show that the pBBR1 and pSC101 vector backbones are most efficient for RNA-guided DNA integration in this comparison study. The efficiency of RNA-guided DNA integration at 5 different target sites was systematically compared between the all-in-one plasmid design (pAIO) and the 3-plasmid design involving multiple T7 promoters and vectors driving the gRNA, the TniQ-Cas8-Cas7-Cas6 operon, and the TnsA-TnsB-TnsC operon. The efficiencies for the 3-plasmid system were normalized to 1, and the relative efficiencies for the pAIO plasmids plotted (FIG. 88B). The results show that in all cases, the total efficiency of the single all-in-one plasmid system is between 2-5-fold higher than the 3-plasmid system.
Figure 88B:
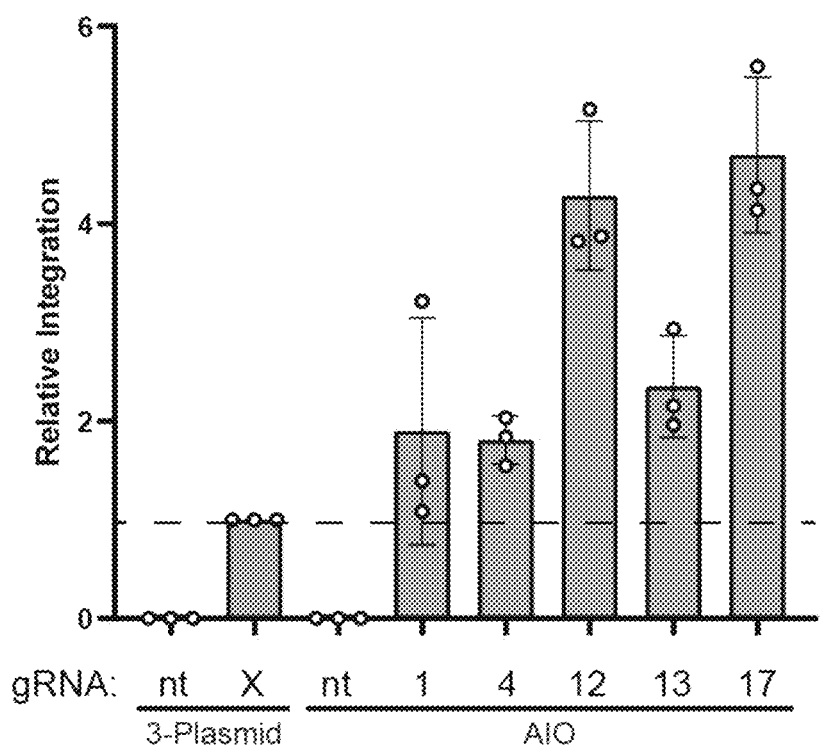
Figure 88C:
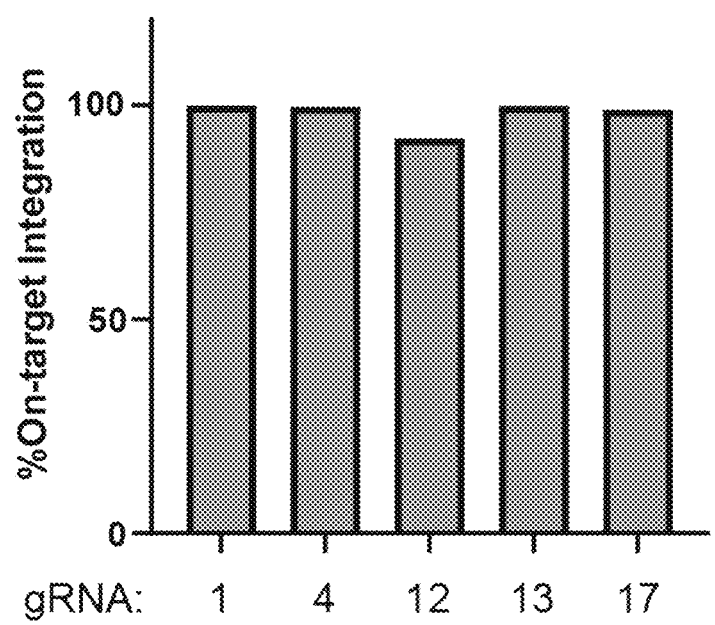
Figure 89:
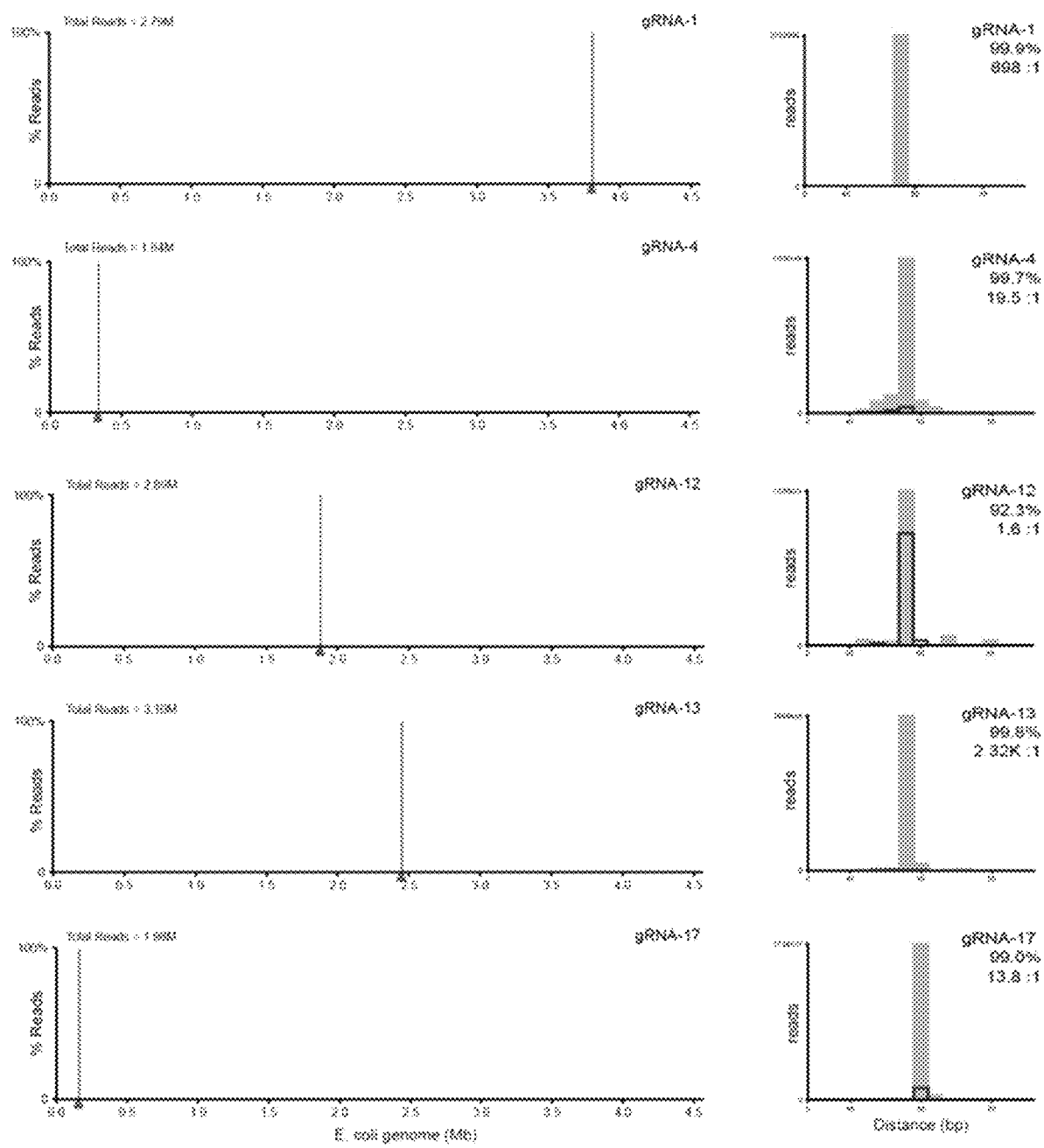
FIG. 89 is the Tn-seq data for the engineered all-in-one pAIO vectors. Genome-wide specificity of gRNA-1, gRNA-4, gRNA-12, gRNA-13, gRNA-17 within the pAIO vector is shown by plotting all the Tn-seq reads across the 5.6-Mbp *E. coli* genome. The inset at the right shows a zoom-in of the on-target peak, and tabulates the on-target specificity (line 2 of text) and the ratio of tRL:tLR orientation (line 3 of text) for the same gRNA-1.

To further simplify, the cargo sequence was cloned onto pCQT, and this all-in-one (pAIO) plasmid construct was tested across 4 different plasmid backbones of varying copy numbers (FIG. 87). In general, higher efficiencies were observed for our lowest copy-number backbones, and AIO constructs based on the pBBR1 and pSL101 reached 90+% integration (FIG. 88A). To see whether the improvement in efficiencies would translate across multiple targets, efficiencies at five target sites previously used in the above example were assessed and it was determined that the pBBR1-based AIO led to significant efficiency increases across the board compared to the initial 3-plasmid approach (FIGS. 88B and 88C). This highly efficient, single-plasmid system maintained remarkable genome-wide specificities, and translated across three common laboratory *E. coli* strains, as revealed by modified TnSeq analysis (FIG. 89).

Surprisingly, qPCR analysis of the pAIO constructs also showed substantial reduction of the strong bi-directional integration at certain targets previously observed with the initial 3-plasmid expression. While investigating this effect, a lac promoter upstream of the Right transposon end on our original pDonor was identified. Removing this lac promoter led to a similar reduction in bi-directional integration at the affected target.

Figure 90A:
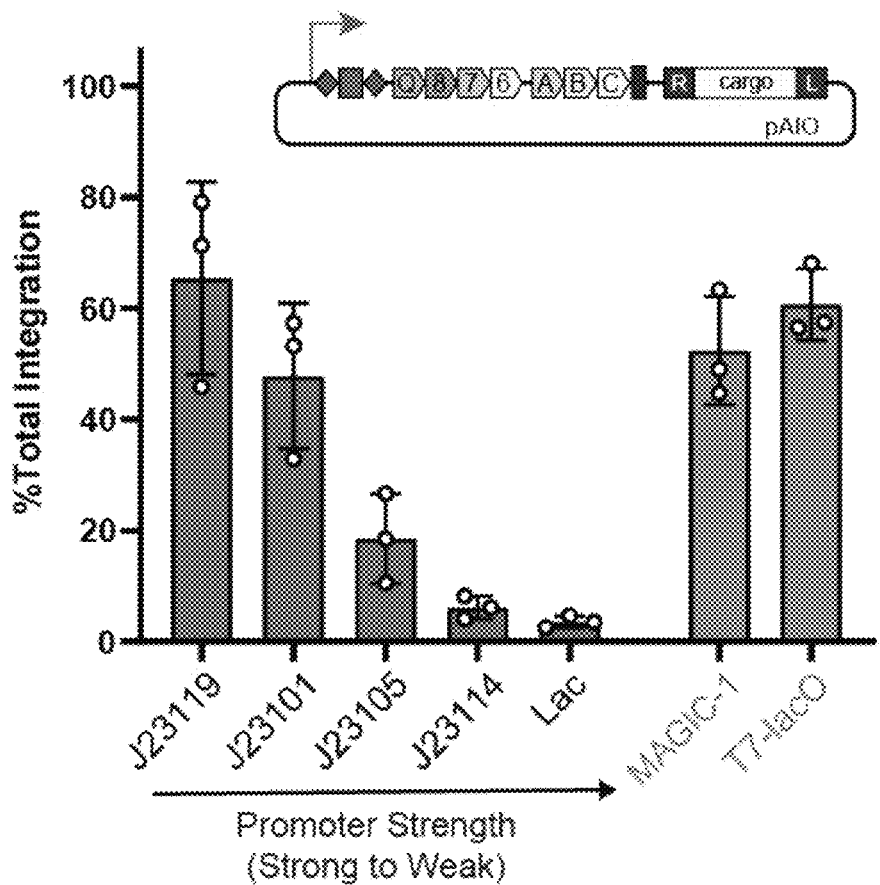
FIGS. 90A-90C show engineered vectors with diverse promoters for RNA-guided DNA integration.
Figure 90B:
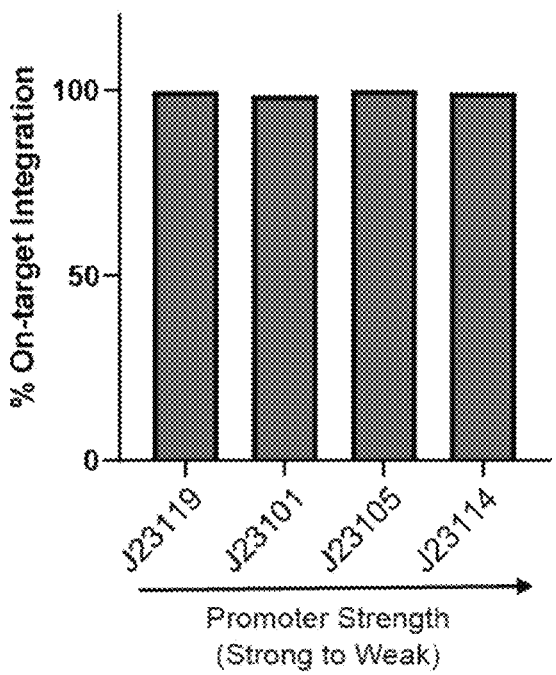

The role of expression strength was assessed by modifying the single promoter driving expression or the RNA-guided DNA integration components (FIG. 90). Utilizing in a panel of artificial constitutive *E. coli* promoters of varying strengths, stronger expression was observed that, in general, drove higher rates of integration, while not affecting genome-wide specificity (FIGS. 90A and 90B). Efficient integration was also shown with a natural broad-host promoter recently adopted for metagenomic microbiome engineering, confirming flexibility in expressing the single transcript construct.

Figure 90C:
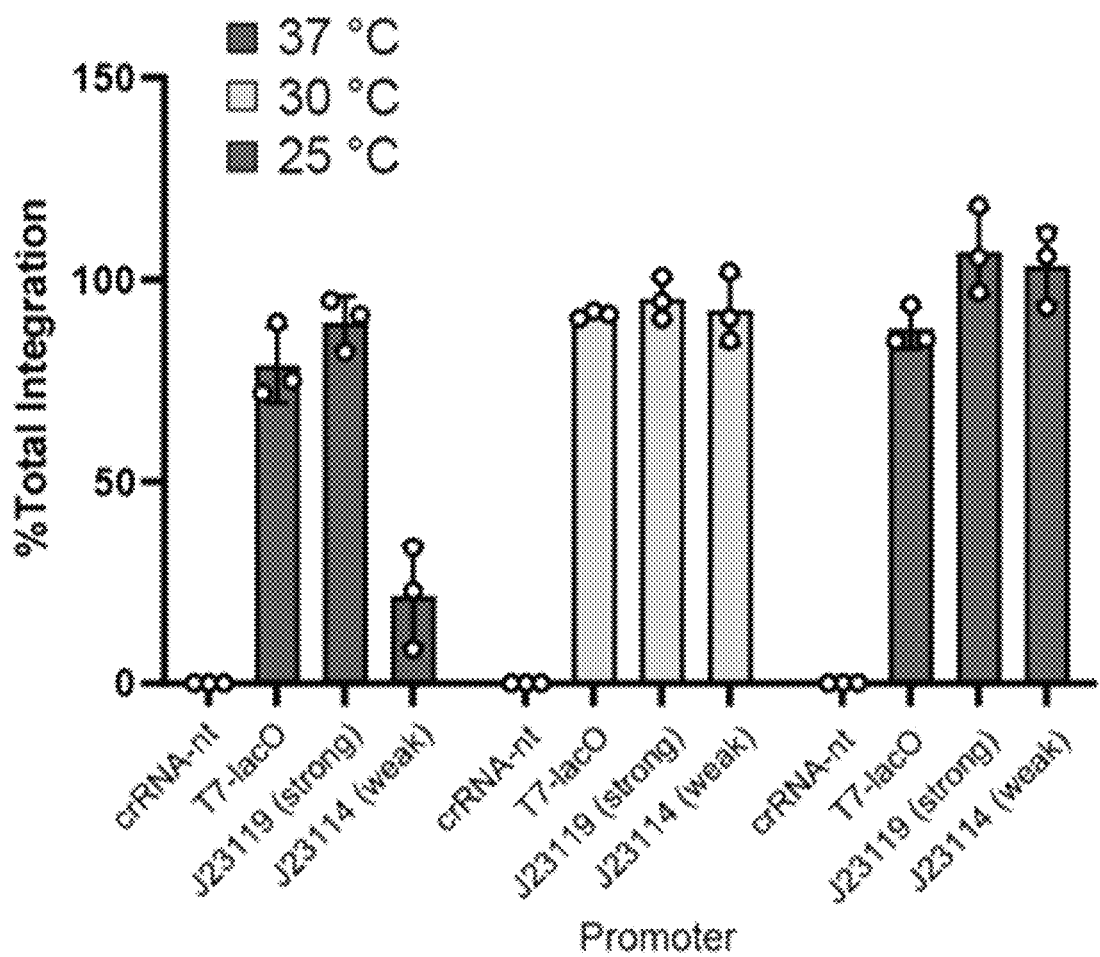

A robust increase in integration efficiency was observed as a result of dropping the incubation temperature (FIG. 90C). This was replicated across three promoter configurations, and at no cost to specificity.

Figure 92A:
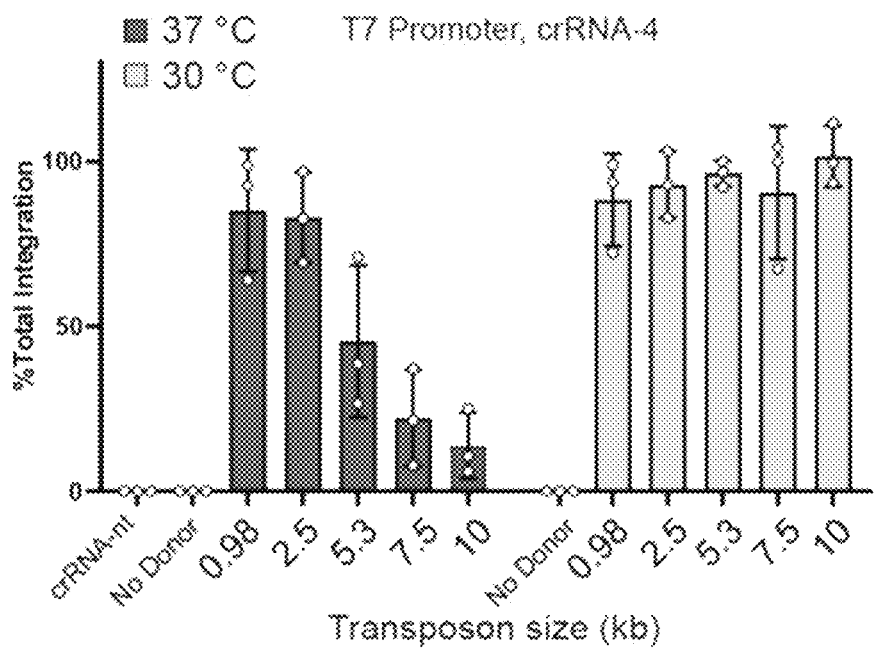
FIGS. 92A-92C show that RNA-guided DNA integration can be stimulated with lower temperature culturing, allowing highly efficient insertion of large genetic payloads in excess of 10-kb. A two-plasmid system was used for RNA-guided DNA integration experiments, comprising pDonor and pCQT driven by a T7 promoter and targeting the E. coli genome with crRNA-4. Negative control experiments (non-target crRNA, "nt"; no donor DNA) show an absence of any integration, as measured by qPCR. When the transformed E. coli cells are cultured on solid media at 37° C., the integration efficiency drops severely as the size of the genetic payload increases from 0.98 kb to 10 kb (FIG. 92A). However, when the exact same transformed cells are instead cultured on solid media at 30° C., the efficiency of integration remains at ~100%, regardless of the size of the genetic payload inserted in pDonor in between the transposon ends. Similar experiments were performed in FIG. 92B, except the expression vector employs a J23119 promoter instead of a T7 promoter. Lower temperature culturing again shows a consistent and statistically significant increase in total integration efficiencies regardless of payload size, as compared to culturing at 37° C. Similar experiments were performed in FIG. 92C, except the expression vector employs a J23119 promoter instead of a T7 promoter, and crRNA-13 was used in place of crRNA-4. Lower temperature culturing again shows a consistent and statistically significant increase in total integration efficiencies regardless of payload size, as compared to culturing at 37° C. pCQT is exemplified by pSL1022 (SEQ ID NO: 855). pDonor is exemplified by pSL1119 (SEQ ID NO: 1755) for the 0.98 kb version, and by pSL1619 (SEQ ID NO: 1756) for the 10 kb version.
Figure 92B:
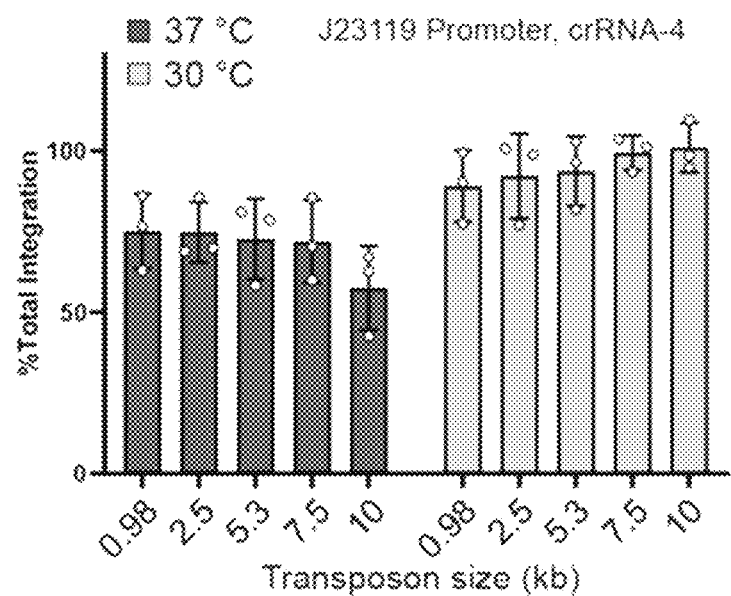
Figure 92C:
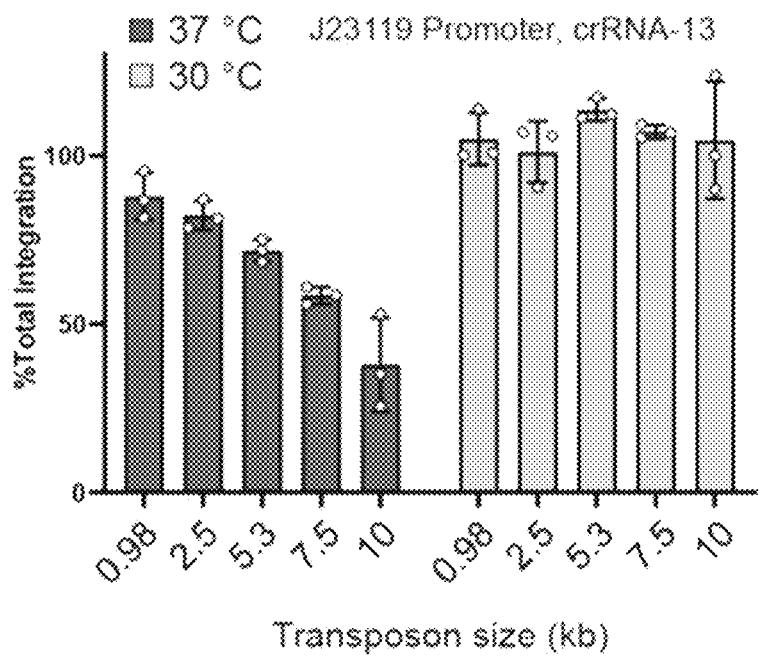

The capability of the single-plasmid construct to deliver large multi-kb genetic payloads was investigated (FIG. 92). The pCQT/pDonor expression approach was used with the large cargos without the complication of potentially unstable AIO plasmids. Initial data using pT7-driven pCQT showed a steep decrease in efficiency with larger cargos, similar to the 3-plasmid systems (FIG. 92A). Transformation efficiencies were affected by the presence of IPTG, thus the T7 promoter was replaced with a strong constitutive promoter to express the system without IPTG toxicity. This replacement resulted improved the efficiency reduction of large cargos (FIGS. 92B-92C). Remarkably, the incubation was further decreased to 30° C., over 90% integration efficiencies were observed across our panel of cargo sizes, and this effect was replicated at a different target sites.

Orthogonal RNA-Guided DNA Integration (INTEGRATE) Systems Enable Multiple Iterative Insertions The efficient mobilization by *Vibrio cholerae* INTEGRATE of any cargo flanked by the transposon ends may indicate that using the same system for multiple iterative insertions into varying loci within the same genome is potentially problematic due to the previously inserted cargo also being mobilized to a new site once a new target is introduced. To confirm this phenomenon, a cargo was inserted at the lacZ target site using an AIO construct on a temperature-sensitive plasmid backbone and a fully integrated clone was isolated and subjected to temperature-based curing. Subsequent introduction of a donor-less effector plasmid with a new crRNA targeting a second locus (glmS) resulted in integration of the genomically integrated cargo, signaling remobilization of this cargo. When a second donor was included along with the machinery, competing insertions were observed at the glmS locus. While the majority of insertion was from the new exogenously introduced donor, there was a small but detectable presence of the genomically derived donor. As such, re-mobilization capacity of genomically integrated cargo sequences and potential cross-contamination effect of different cargos during iterative rounds of integration.

Tapping into the diverse potential pool of functional CRISPR-associated, RNA-guided transposases, a phylogenetically distant yet active transposase system from *Scytonema hofinannii* strain PCC 7110 was discovered, which utilizes a Type-V, C2c5 (Cas12k) protein for DNA binding. This ShoC2c5 system inserted its donor in two possible orientations, and also exhibited target site immunity similar to the Vch system.

Figure 97A:
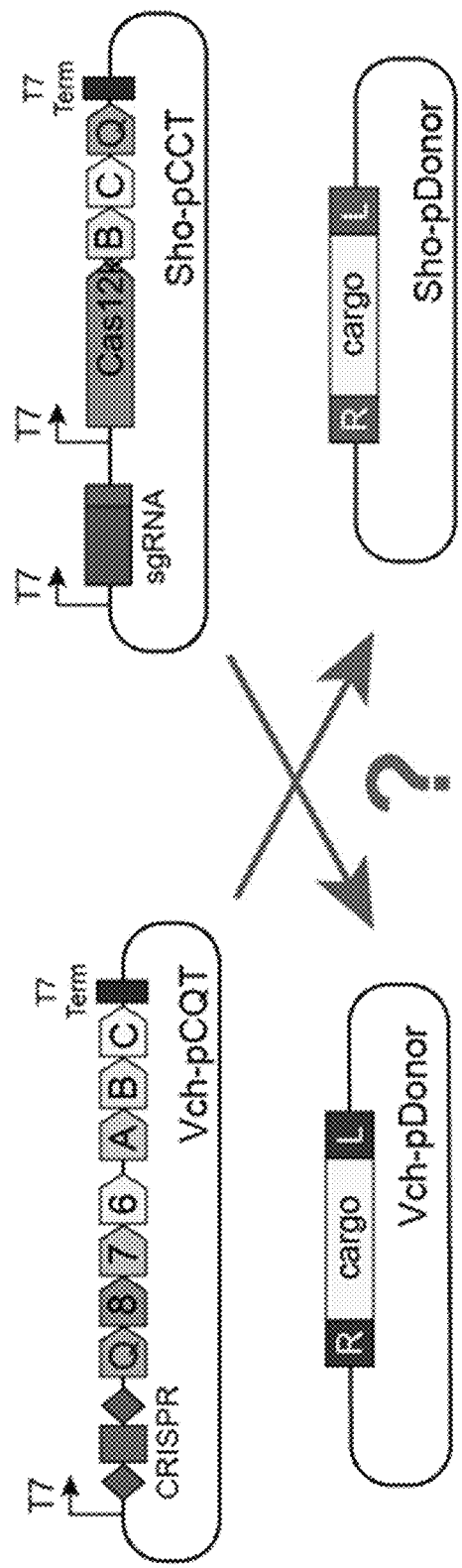
FIGS. 97A-97B show that two engineered CRISPR-transposon systems do not cross-react and thus can be used as orthogonal RNA-guided DNA integration systems.
Figure 97B:
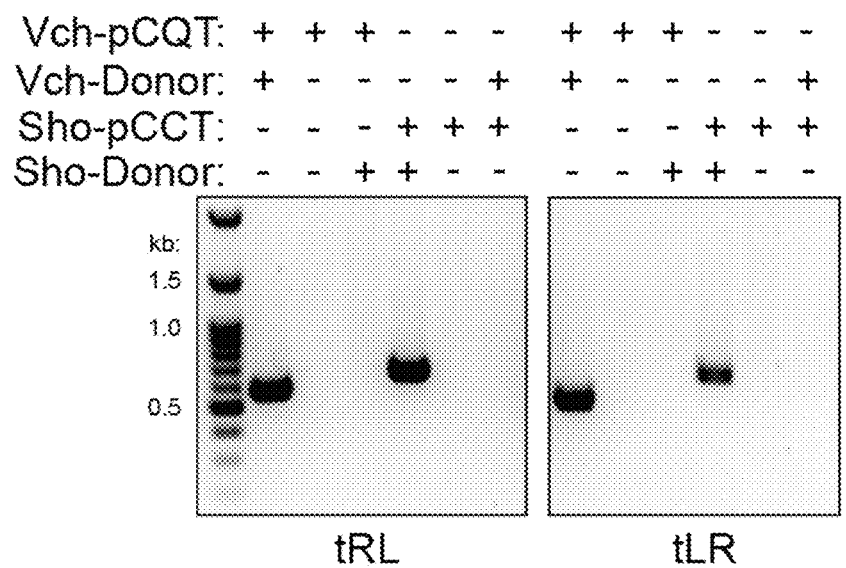

While both systems function with their respective donors, they were unable to direct guided insertions with each other's donors, as confirmed by PCR. Thus, using this Sho INTEGRATE system, a clean second DNA insertion was made into the isolated clone with a previously integrated with a Vch cargo, as confirmed by qPCR data (FIG. 97).

Figure 94A:
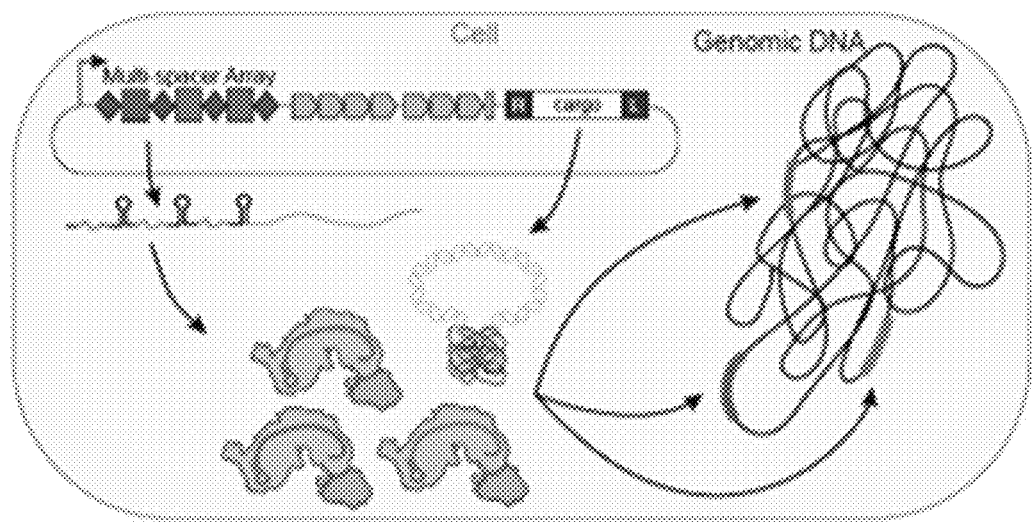
FIGS. 94A-94C demonstrate multiplexed RNA-guided DNA integration using multiple-spacer CRISPR arrays. By encoding multiple distinct spacers within an expanded CRISPR array, engineered CRISPR-transposon systems can be easily turned into a multiplexed platform for DNA insertions proximal to multiple target sites within the same genomic DNA (FIG. 94A). Processing of long precursor CRISPR RNAs is straightforward in Type I CRISPR-Cas systems that employ Cas6 for ribonucleolytic processing. CRISPR arrays were constructed (FIG. 94B, left), in which a maroon spacer sequence was either not present (top), the only spacer present (second from top), or one of multiple distinct spacers and situated within different positions of the CRISPR array relative to the transcription start site 5' of the CRISPR array. For each distinct construct, RNA-guided DNA integration experiments were performed in E. coli BL21(DE3) cells, and the efficiency of RNA-guided DNA integration proximal to the genomic target site programmed by the maroon spacer was measured by qPCR. The total efficiency is plotted relative to the efficiency for the maroon spacer when it is the only spacer in the array (FIG. 94B, right). The results demonstrate that even when present as one of three distinct spacers, the maroon spacer can still direct RNA-guided DNA integration at >50% wild-type efficiencies, and has highest activity when it's closest to the 5' transcription start site. Genome-wide specificity analysis from a Tn-seq library (FIG. 94C) was generated from cells that underwent multiplexed donor DNA integration using a CRISPR array encoding three distinct spacer sequences. Tn-seq analysis revealed that 99.6% of reads are present exclusively at one of the three target sites, indicating a very high efficiency and on-target accuracy of multiplexed integration. Because ligation efficiencies are known to be sequence-dependent, and other confounding factors contribute to nose in the total height of peaks from next-generation sequencing, no conclusions can be drawn regarding the relative efficiency for DNA integration at these three sites from the Tn-seq profile. 2-spacer-array constructs are exemplified by pSL1202 (SEQ ID NO: 1757), 3-spacer-array constructs are exemplified by pSL1341 (SEQ ID NO: 1758).

Vch RNA-guided DNA integration (INTEGRATE) as a powerful tool for single-step multiplexed DNA insertions Due to the independence of the cargo sequence from its intended target, it was possible to insert the same cargo at multiple loci within the same genome in a single step, through the simultaneous expression of multiple crRNAs (FIG. 94A). Furthermore, by taking advantage of the native crRNA processing capability of Cas6, these multiple spacers were expressed within single CRISPR arrays as part of the single-promoter, single-plasmid AIO construct, providing an avenue for convenient single-step multiplexed integration.

Figure 94B:
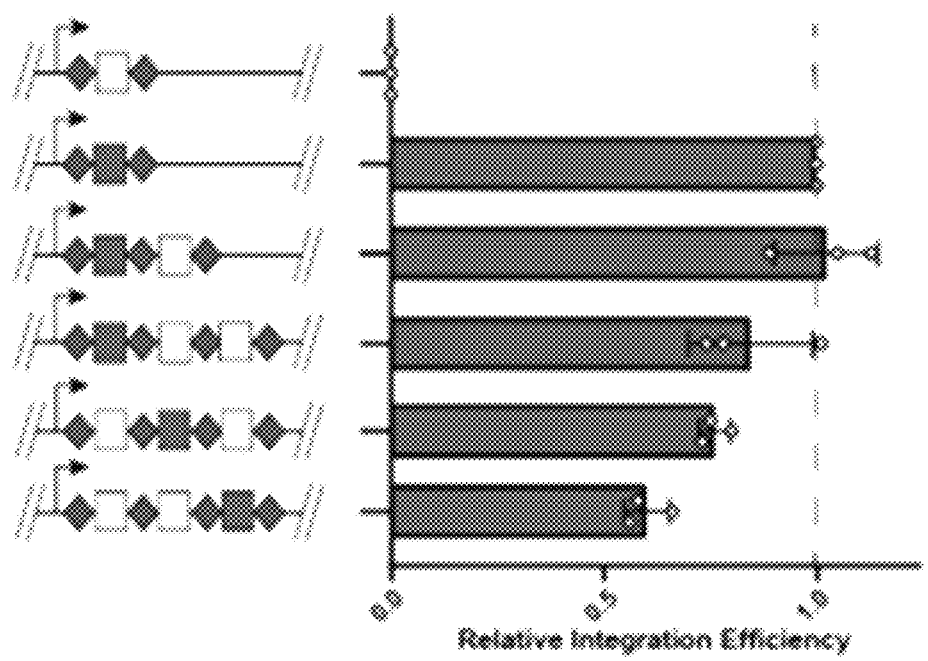

The ability of these multi-spacer arrays to produce functional insertions was evaluated. By qPCR, the integration efficiencies were measured at the lacZ locus when the lacZ spacer was first in a one, two, or three-spacer crRNA array; adding more spacers to the array did not considerably affect activity. Within the three-spacer arrays, the lacZ spacer was moved to the second or third position and a gradual but minimal decrease in activity compared to the first position was observed (FIG. 94B).

Figure 94C:
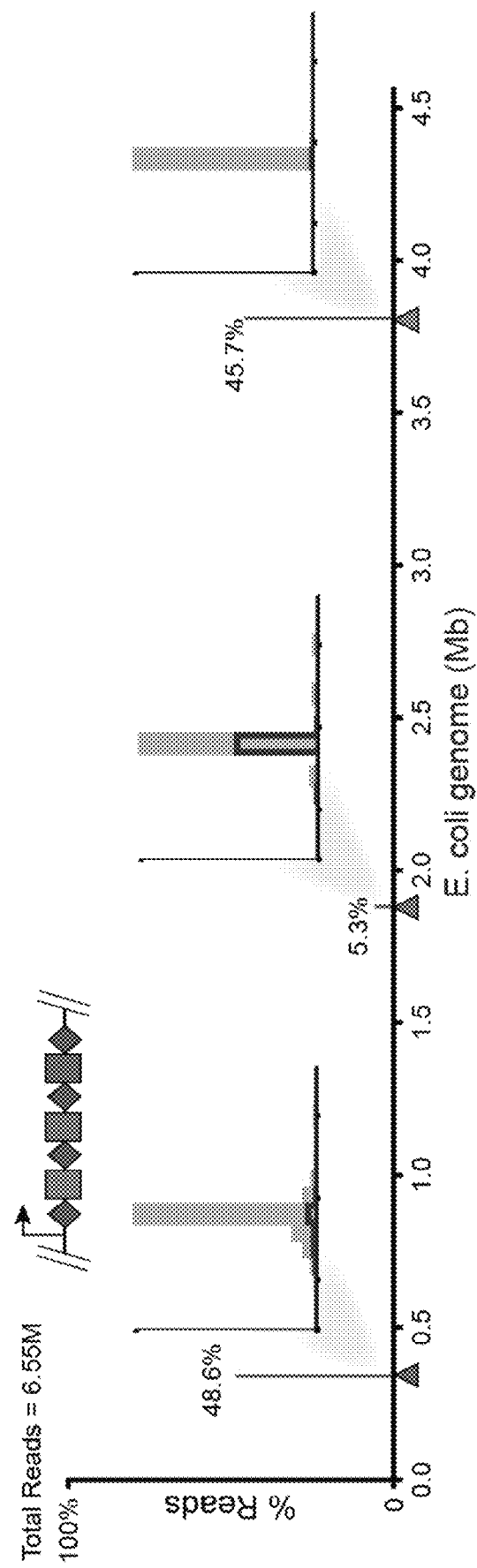

Using the multi-spacer AIO constructs, PCR integration was observed at all sites targeted. Genome-wide Tn-Seq analysis of transformed populations confirmed that multi-spacer INTEGRATE retained high specificity while distributing insertions to multiple target sites. Furthermore, double and triple-inserted clones were isolated by PCR (FIG. 94C).

Figure 95B:
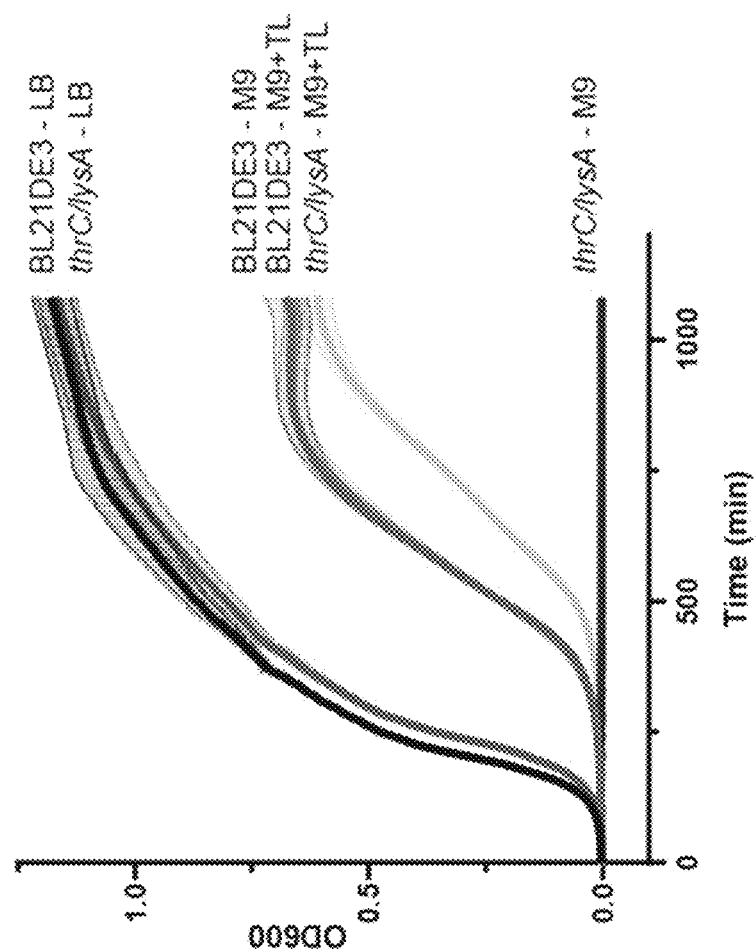
FIGS. 95A-95B show that multiplexed RNA-guided DNA integration results in predictable phenotypic outcomes. A multiple-spacer CRISPR array was constructed, in which one spacer targets thrC for insertional inactivation, and a second spacer targets lysA for insertional inactivation (FIG. 95A, top). Cells undergoing multiplexed RNA-guided DNA integration should become auxotrophic for threonine and lysine, because they can no longer synthesize these amino acids from carbon sources due to the knockout insertions within these two genes. To test this hypothesis, E. coli cells were transformed and then plated the resulting transformants on either M9 minimal media, M9 minimal media plus lysine, M9 minimal media plus threonine, or M9 medial media plus threonine and lysine. Cells that became auxotrophic were only able to grow on plates that had the corresponding amino acid, and thus, relative colony counting on the various LB-agar plates directly revealed the efficiency of multiplexed RNA-guided DNA integration. These experiments showed that ~20% of cells were immediately a double-auxotrophic after this single-step multiplex RNA-guided DNA integration activity (FIG. 95A, bottom). To further corroborate these results, clones isolated from various plates were grown in liquid culture in the presence of various media sources, and then their growth was measured over time in a shaking microplate incubator and reader. The results (FIG. 95B) demonstrate that the strains expected to be doubly auxotrophic indeed were completely unable to grow in minimal media alone, and instead required both threonine and lysine ("TL") in the M9 minimal media in order to survive. Construct in panel A is exemplified by pSL1642 (SEQ ID NO: 1759).
Figure 95A:
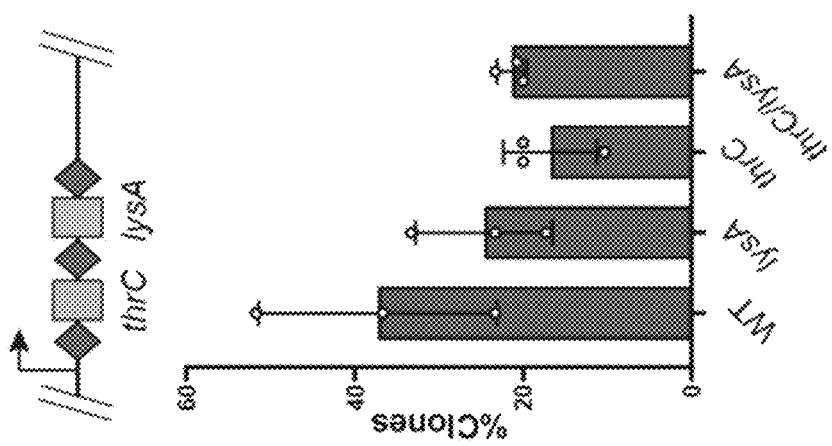
Figure 96A:
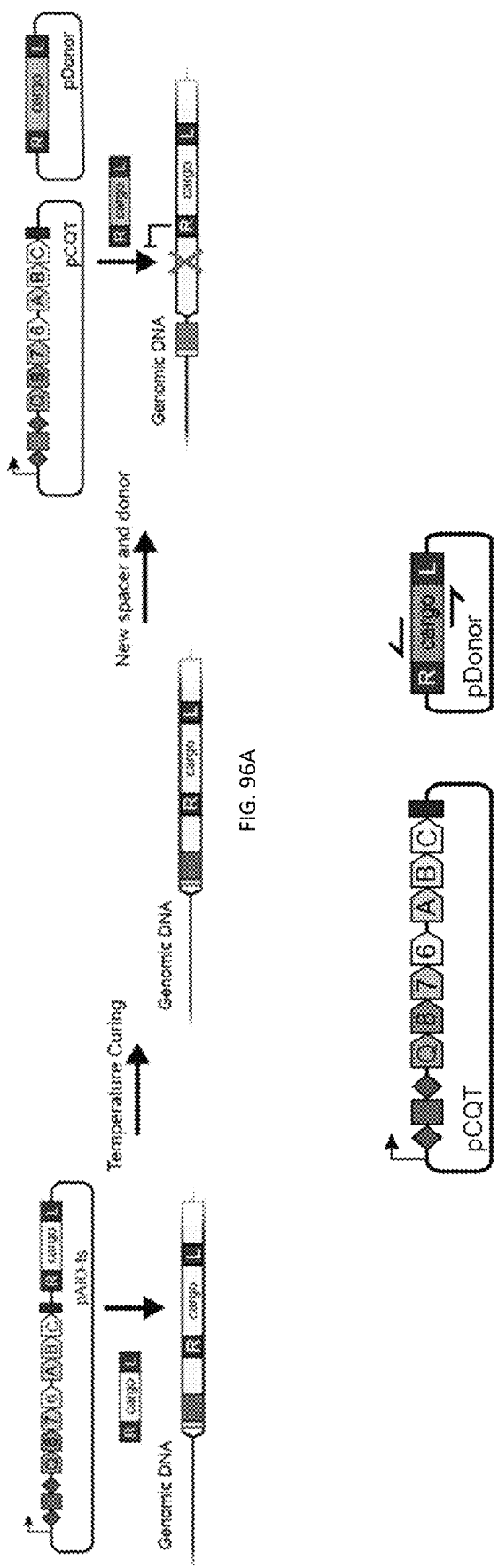
FIGS. 96A-96C show an engineered CRISPR-transposon system for mobilizing donor DNA within cells. Tn7-like transposons exhibit target immunity, in which the presence of one genomically integrated transposon represses the same target site from undergoing another round of integration.
Figure 96B:
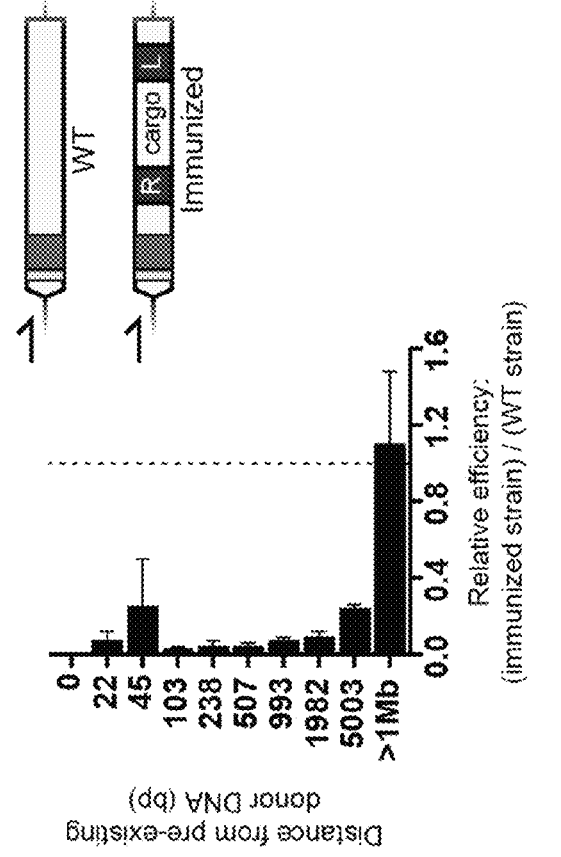
Figure 96C:
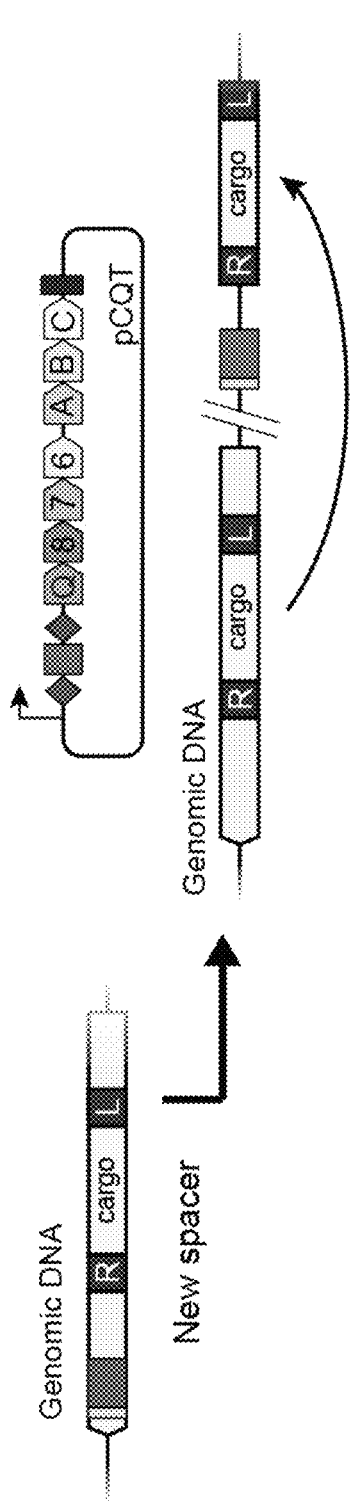

Proof-of-concept applications of the multiplexable system were explored that could also confirmed that these simultaneous insertions were indeed occurring in the same individual genomes, as opposed to orthogonally in multiple genomes within polyclonal colonies. The first application utilized the multiplexed AIO constructs to direct single step insertional knockouts of multiple genes. genes involved in amino acid auxotrophy were targeted, in particular thrC and lysA, as knocking out these genes in *E. coli* produces phenotypic requirements for threonine and lysine in minimal M9 growth media. Spacers for both thrC and lysA were incorporated in the 2-spacer AIO construct, and double knockouts were routinely isolated by colony screening on minimal media (FIG. 95A). Isolated double knockouts were confirmed by PCR, as well as by overnight growth assays, where the isolated clones required both lysine and threonine for growth. In addition, the stability of these double insertions was probed by continuous culturing of a clone in rich media, with all the relevant machineries still being present, for approximately 50 doubling cycles (FIG. 95B). The resulting cells remained refractory to minimal media growth unless provided the combination of amino acids, this indicating the stability of INTEGRATE insertions in producing functional phenotypes.

Figure 91A:
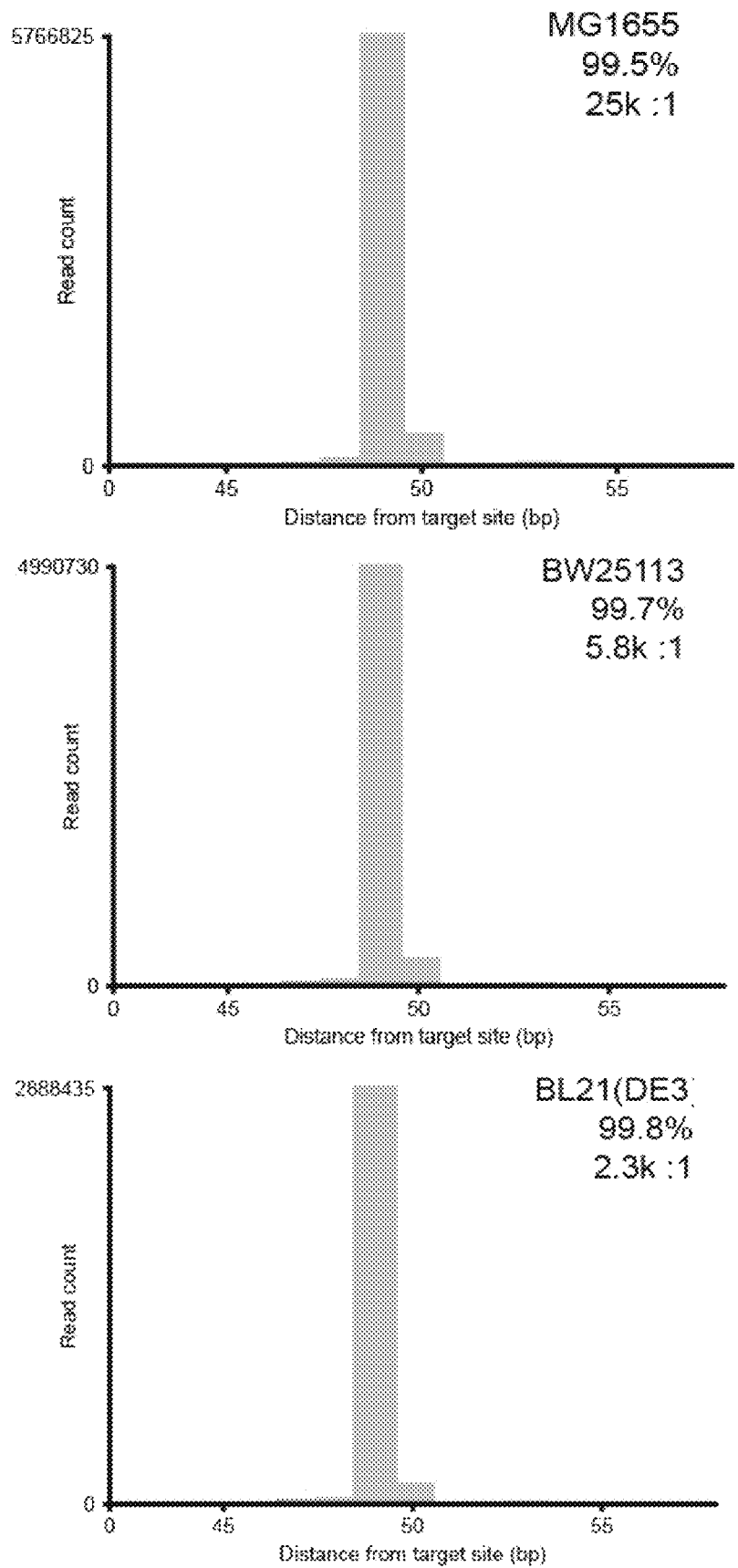
FIGS. 91A-91B show that RNA-guided DNA integration proceeds independent of specific host factors and recombination factors. Using the all-in-one pAIO vectors that contain the strong constitutive promoter J23119, multiple different E. coli strains were transformed, including MG1655, BW25113, and BL21(DE3). The genome-wide specificity of RNA-guided DNA integration was analyzed within each genetic background, and the data plotted represent the integration events at the on-target site (FIG. 91A). In addition, the text in the upper right within each plot reports the on-target specificity (line 2), measured by comparing reads at the on-target site divided by all genome-mapping reads, as well as the orientation bias for tRL:tLR. These experiments demonstrate that the advantageous specificity profile, and the near-exclusive orientation preference for tRL, are excellently reproduced across multiple distinct E. coli strains. Using the all-in-one pAIO vector that contains the strong constitutive promoter J23119 (exemplified by pSL1130, SEQ ID NO: 864), multiple Keio knockout strains were transformed, in which the gene knockouts are shown along the x-axis. For each strain, the integration efficiency is plotted relative to the WT BW25113 strain (FIG. 91B). These results indicate that the recA recombinase is completely dispensable for RNA-guided DNA integration, as are the factors recD, recF, and mutS.
Figure 91B:
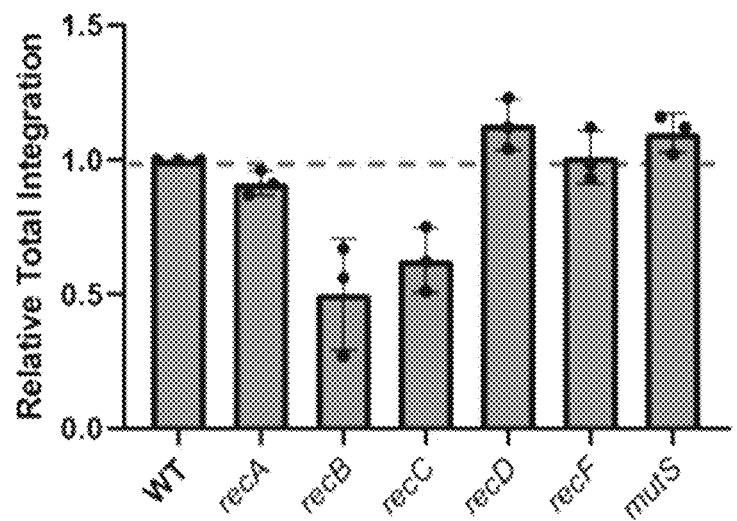

Application of RNA-Guided DNA Integration (INTEGRATE) in Diverse Genetic Backgrounds Without being bound by theory, the proposed mechanism of the canonical *E. coli* Tn7 system may involve staggered double-strand cuts at both ends of the donor as well as at the insertion site, followed by joining of the 3' ends of the excised transposon to the 5' ends at the target, and subsequent simple repair of the remaining gaps at the 5' transposon end. As the RNA-guided DNA integration system described herein utilizes transposase proteins homologous to ones of canonical Tn7, whether DNA transposition activity was dependent on common homologous recombination factors or mismatch repair was investigated. The transposition efficiencies in a panel of Keio *E. coli* strains, with RecA, B, C, D, F or mutS individually knocked out were evaluated by qPCR, and active transposition was observed across all 6 knockouts (FIG. 91).

Figure 98A:
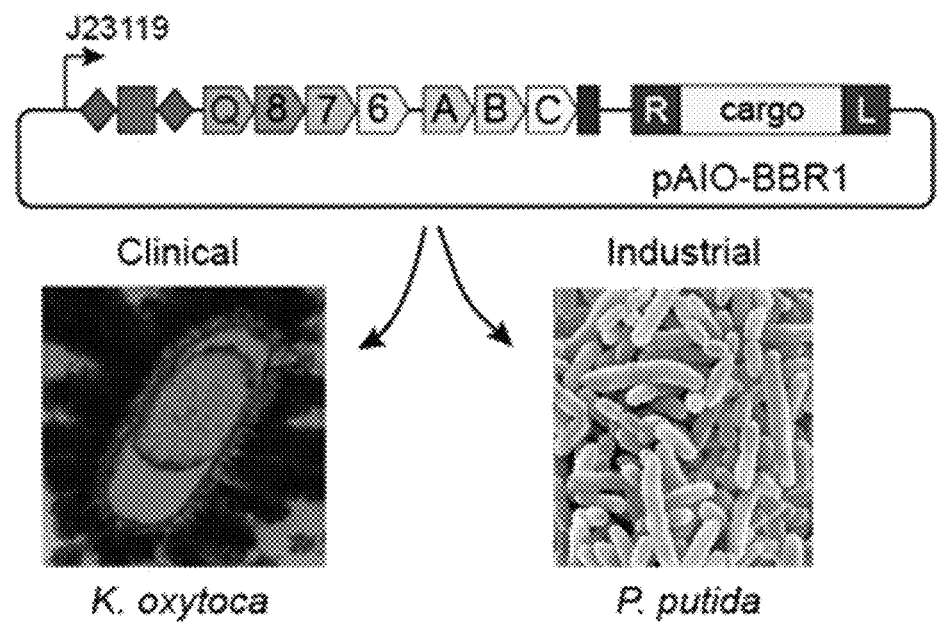
FIGS. 98A-98D show that an engineered CRISPR-transposon system functions robustly in multiple other bacterial species. A modified, engineered all-in-one plasmid with the CRISPR-transposon system derived from *Vibrio cholerae* strain HE-45, in which the machinery and donor DNA is cloned into the broad host range pBBR1 backbone (pAIO-BBR1), was generated. Within this vector, we used a strong constitutive J23119 promoter, that is also known to be recognized by diverse Gram-negative bacteria, was used. Using this engineered plasmid, different spacer sequences were cloned in order to direct RNA-guided DNA integration in *Klebsiella oxytoca* and *Pseudomonas putida*. *P. putida* and *K. oxytoca* were electroporated with pAIO-BBR1 containing spacers targeting multiple distinct genes, and successful integration was probed using one of four distinct primer pairs, a-d, to look for either the tRL or tLR orientation (FIG. 98B), and look at both the upstream and downstream genome-transposon junction.
Figure 98B:
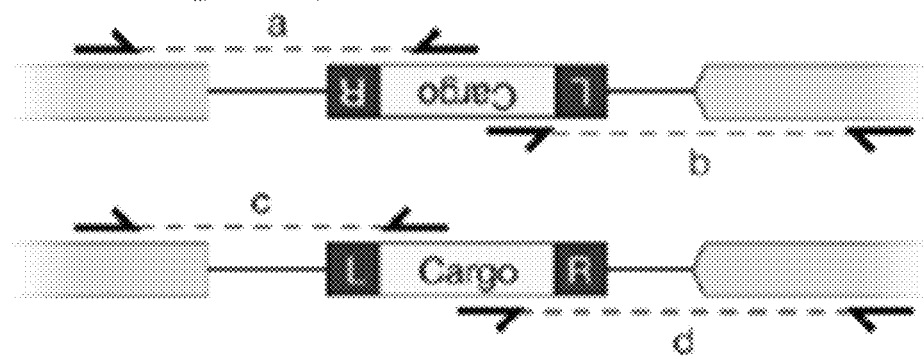
Figure 98C:
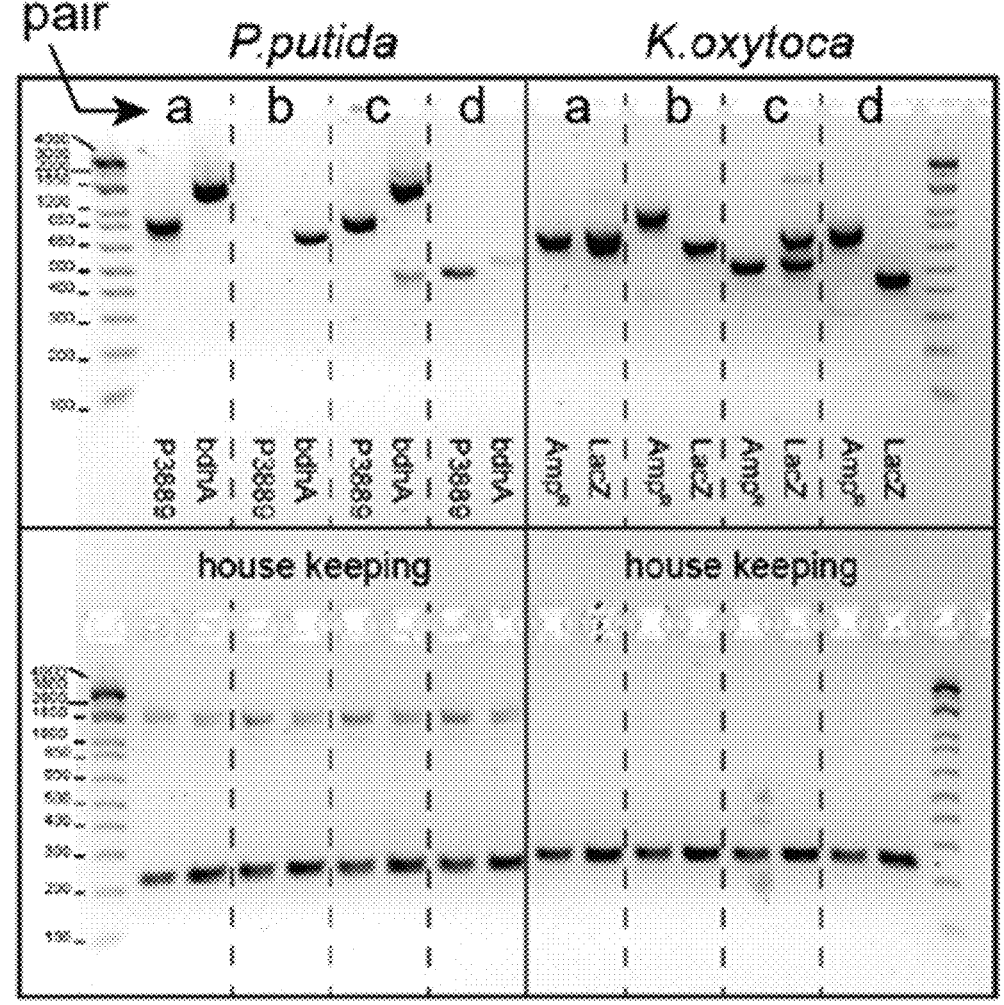
Figure 98D:
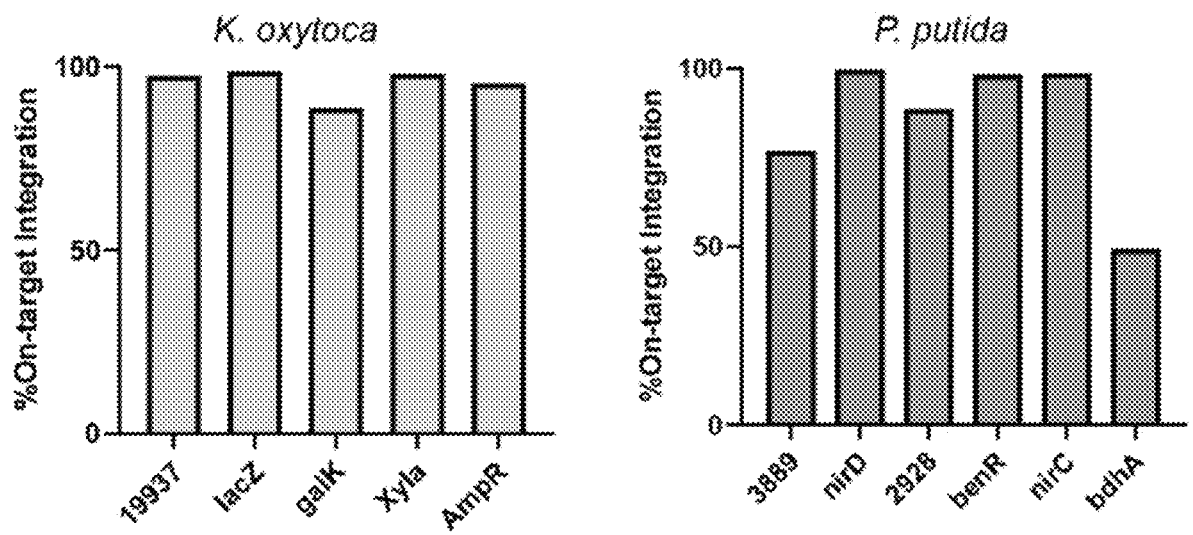

Expanding beyond the *E. coli* genetic background, the system was applied in other genetic backgrounds. *Klebsiella oxytoca*, a clinically relevant pathogen implicated in drug-resistant infections, and *Pseudomonas putida*, an important bacteria platform for biotechnological and industrial applications were selected for testing with the RNA-guided DNA integration system (FIG. 98A). The AIO construct on the pBBR1 plasmid backbone, driven by the strong J23119 constitutive promoter was used. activity at all 4/4 *P. putida* and 5/5 *K. oxytoca* target sites (FIG. 4) was observed by PCR and confirmed by Sanger sequencing (FIGS. 98B and 98C. Data from the Tn-Seq analysis further confirmed successful cargo integration at these sites, as well as high genome-wide specificity (FIG. 98D).

A Self-Propagating Genetic Element with Vch RNA-Guided DNA Integration (INTEGRATE)

Figure 93A:
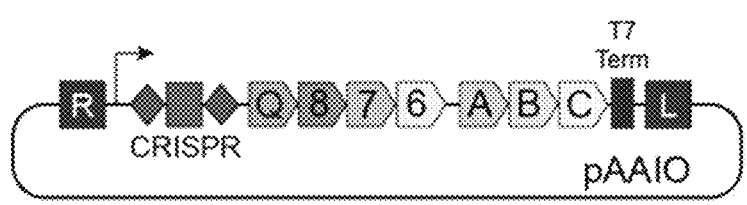
FIGS. 93A-93B show that a fully autonomous, self-mobilizable mobile genetic element undergoes highly-efficient RNA-guided DNA integration. An autonomous all-in-one plasmid (pAAIO) was constructed (FIG. 93A), in which the promoter-driven operon encoding the gRNA and all 7 protein components (TniQ-Cas8-Cas7-Cas6-TnsA-TnsB-TnsC), is inserted directly in between the transposon left and right ends. This converts the mini-transposon into a self-mobilizable element, in which the machinery directing RNA-guided DNA integration inserts the donor DNA into a target site, which then encodes the machinery to continue mobilizing the same donor DNA to any target site programmed within the CRISPR array. Despite the large size of the genetic payload (>10 kb), RNA-guided DNA integration (FIG. 93B) of the donor DNA in pAAIO proceeds with ~100% efficiency, without any drug selection, when the transformed E. coli cells are cultured at 30° C. as opposed to 37° C. pAAIO is exemplified by pSL1184 (SEQ ID NO: 1747).
Figure 93B:
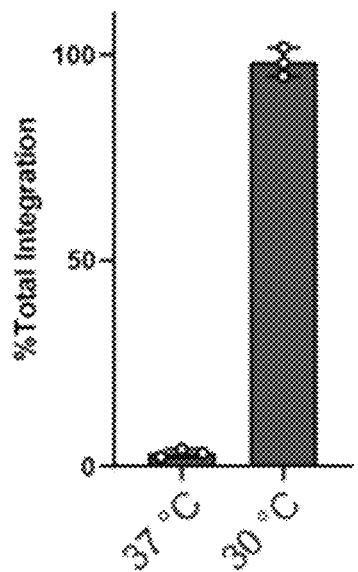

A fully programmable, self-propagating autonomous transposon system was created that construct contains a multi-spacer, single CQT operon within the transposon flanking sequences, allowing the system to now mobilize genetic encoding of its own effector units as part of the cargo. The capacity for the genomically inserted cargo to be remobilized from the introduction of a new spacer or target was demonstrated (FIG. 93), thus an autonomous system self-propagates in a pre-programmed way by first using a spacer to insert into horizontally transferred plasmids. Once the plasmid has been transferred to a different naïve cell through conjugation, the onboard system leverages a second, genome specific spacer to integrate into a predetermined locus within this naïve cell, completing a cycle of propagation.

The self-contained, autonomous INTEGRATE construct (pAAIO) was evaluated in the *E. coli* conjugation-capable S17 strain. The test version of pAAIO contained a 2-spacer array: one allowing for insertion into both the initial *E. coli* genome, as well as from *E. coli* into a similar target site on our conjugative pBBR1 plasmid; the second spacer targeting the *Klebsiella oxytoca* genomic beta-lactamase gene. pAAIO was successfully integrated into *E. coli* at 90+% efficiency, followed by temperature curing of the vessel plasmid and selection of an integrated clone.

The ability to efficiently make precise insertions of large genetic cargos into bacterial genomes, without the need for DSBs or drug selection, is valuable for a variety of strain engineering applications. Through rational engineering steps, versions of the *Vibrio cholerae* RNA-guided DNA integration systems that express all the necessary components were constructed using minimal genetic parts in two-plasmid or all-in-one, single-plasmid constructs. These minimal constructs enabled customizations in few cloning steps, and produced efficient insertions after a single transformation step and subsequent incubation. Leveraging crRNA processing of the Cas6 subunit, AIO versions were easily modified to express multi-spacer CRISPR arrays and facilitated multiple simultaneous insertions in the same simple workflow, allowing for rapid engineering of bacterial genomes.

RNA-Guided DNA Integration at Temperatures Below 37° C.

Competent *E. coli* cells are transformed with the appropriate plasmids required for RNA-guided DNA integration, and the transformants are recovered in LB media at 37° C. for 1-1.5 hours. Recovered cells are then plated on LB-agar with appropriate antibiotic selection, and with 0.1 mM IPTG if required for induction of T7 promoters. The plates are incubated at 20-35° C., e.g., 30° C. or 25° C., for at least 24 hours, e.g., 30 hours. Colonies are then scraped and lysed for further analysis.

Multiplexed RNA-Guided DNA Integration with Multiple gRNAs

Combinations of 2 or 3 spacers are cloned into the CRISPR array in pAIO entry vectors using either 2 or 3 pairs of oligoduplexes with compatible sticky ends. Competent *E. coli* cells are transformed with the resulting construct(s), and the RNA-guided DNA integration assays are carried out using previously described methods. Double or triple inserted cells are screened by colony PCR across each of the respective target sites, or by using phenotypic selection based on the targets of integration (e.g. blue-white colony screens for lacZ insertions, colony screens on M9 minimal media for insertions targeting thrC or lysA).

Programmed Genomic Deletions Using a CRISPR-Transposon-Recombinase System

Competent *E. coli* cells are transformed with the pAIO-derived construct containing a pair of spacers cloned as described previously, where both gRNAs target the same genomic strand and the gRNAs flank the sequence intended for deletion. The mini-transposon donor DNA contains a recombination sequence, such as a loxP recognition sequence, adjacent to the transposon right end sequence; in other embodiments, alternative recombination sequences may be used, and the recombination sequence may be contained within other regions of the donor DNA. Transformed cells are recovered for 1-1.5 hours at 37° C. in liquid LB media, and are incubated on LB-agar with appropriate antibiotic selection at 37° C. for 24 hrs. Colonies are scraped and plated at different dilutions on LB-agar for a second overnight to obtain clonal colonies. Colonies are screened for double insertions and are then made competent using standard methods.

The scope of the present invention is not limited by what has been specifically shown and described hereinabove. Those skilled in the art will recognize that there are suitable alternatives to the depicted examples of materials, configurations, constructions and dimensions. Numerous references, including patents and various publications, are cited and discussed in the description of this invention. The citation and discussion of such references is provided merely to clarify the description of the present invention and is not an admission that any reference is prior art to the invention described herein. All references cited and discussed in this specification are incorporated herein by reference in their entirety. Variations, modifications and other implementations of what is described herein will occur to those of ordinary skill in the art without departing from the spirit and scope of the invention. While certain embodiments of the present invention have been shown and described, it will be obvious to those skilled in the art that changes and modifications may be made without departing from the spirit and scope of the invention. The matter set forth in the foregoing description is offered by way of illustration only and not as a limitation.

---

SEQUENCE LISTING (2005 sequences)

SEQ ID NO: 1 - DNA, 9467 bp, artificial sequence
  Synthetic
cgggatctcgacgctctcccttatgcgactcctgcattaggaaattaatacgactcactataggggaattgtgagcggataacaattcccctgtagaaataattttgtttaactttaataaggagatataccatggctaaagcaaactcttcattttctgaagtgcaaattgcccgtcgtattaaagaggggcgtggccaagggcatggtaaagactatattccatggctaacagtacaagaagttccttcttcaggtcgttcccaccgtatttattctcataagacgggacgagtccatcatttgctatctgacttagagcttgctgtttttctcagtcttgagtgggagagcagcgtgctagatatacgcgagcagttccccttattacctagtgataccaggcagattgcaatagatagtggtattaagcatcctgttattcgtggtgtagatcaggttatgtctactgattttttagtggactgcaaagatggtccttttgagcagtttgctattcaagtcaaacctgcagcagccttacaagacgagcgtaccttagaaaaactagaactagagcgtcgctattggcagcaaaagcaaattccttggttcatttttactgataaagaaataaatcccgtagtaaaagaaaatattgaatggctttattcagtgaaaacagaagaagtttctgcggagcttttagcacaactatccccattggcccatatcctgcaagaaaaaggagatgaaaacattatcaatgtctgtaagcaggttgatattgcttatgatttggagttaggcaaaacattgagtgagatacgagccttaaccgcaaatggttttattaagttcaatatttataagtctttcagggcaaataagtgtgcagatctctgtattagccaagtagtgaatatggaggagttgcgctatgtggcaaattaatgaggttgtgctatttgataatgatccgtatcgcattttggctatagaggatggccaagttgtctggatgcaaataagcgctgataaaggagttccacaagctagggctgagttgttgctaatgcagtatttagatgaaggccgcttagttagaactgatgacccttatgtacatcttgatttagaagagccgtctgtagattctgtcagcttccagaagcgcgaggaggattatcgaaaaattcttcctattattaatagtaaggatcgtttcgaccctaaagtcagaagcgaactcgttgagcatgtggtccaagaacataaggttactaaggctacagtttataagttgttacgccgttactggcagcgtggtcaaacgcctaatgcattaattcctgactacaaaaacagcggtgcaccaggggaaagacgttcagcgacaggaacagcaaagattggccgagccagagaatatggtaagggtgaaggaaccaaggtaacgcccgagattgaacgcctttttaggttgaccatagaaaagcacctgttaaatcaaaaaggtacaaagaccaccgttgcctatagacgatttgtggacttgtttgctcagtattttcctcgcattccccaagaggattacccaacactacgtcagtttcgttatttttatgatcgagaataccctaaagctcagcgcttaaagtctagagttaaagcaggggtatataaaaaagacgtacgacccttaagtagtacagccacttctcaggcgttaggccctgggagtcgttatgagattgatgccacgattgctgatatttatttagtggatcatcatgatcgccaaaaaatcataggaagaccaacgctttacattgtgattgatgtgtttagtcggatgatcacgggcttttatatcggctttgaaaatccgtcttatgtggtggcgatgcaggcttttgtaaatgcttgctctgacaaaacggccatttgtgcccagcatgatattgagattagtagctcagactggccgtgtgtaggtttgccagatgtgttgctagcggaccgtggcgaattaatgagtcatcaggtcgaagccttagtttctagttttaatgtgcgagtggaaagtgctccacctagacgtggcgatgctaaaggcatagtggaaagcacttttagaacactacaagccgagtttaagtcctttgcacctggcattgtagagggcagtcggatcaaaagccatggtgaaacagactataggttagatgcatctctgtcggtatttgagttcacacaaattattttgcgtacgatcttattcagaaataaccatctggtgatggataaatacgatcgagatgctgattttcctacagatttaccgtctattcctgtccagctatggcaatggggtatgcagcatcgtacaggtagtttaagggctgtggagcaagagcagttgcgagtagcgttactgcctcgccgaaaggtctctatttcttcatttggcgttaatttgtggggtttgtattactcggggtcagagattctgcgtgagggttggttgcagcggagcactgatatagctagacctcaacatttagaagcggcttatgacccagtgctggttgatacgatttatttgtttccgcaagttggcagccgtgtattttggcgctgtaatctgacggaacgtagtcggcagtttaaaggtctctcattttgggaggtttgggatatacaagcacaagaaaaacacaataaagccaatgcgaagcaggatgagttaactaaacgcagggagcttgaggcgtttattcagcaaaccattcagaaagcgaataagttaacgcccagtactactgagcccaaatcaacacgcattaagcagattaaaactaataaaaaagaagccgtgacctcggagcgtaaaaaacgtgcggagcatttgaagccaagctcttcaggtgatgaggctaaagttattcctttcaacgcagtggaagcggatgatcaagaagattacagcctacccacatacgtgcctgaattatttcaggatccaccagaaaaggatgagtcatgagtgctacccggattcaagcagtttatcgtgatacgggggtagaggcttatcgtgataatccttttatcgaggccttaccaccattacaagagtcagtgaatagtgctgcatcactgaaatcctctttacagcttacttcctctgacttgcaaaagtcccgtgttatcagagctcataccatttgtcgtattccagatgactattttcagccattaggtacgcatttgctactaagtgagcgtatttcggtcatgattcgaggtggctacgtaggcagaaatcctaaaacaggagatttacaaaagcatttacaaaatggttatgagcgtgttcaaacgggagagttggagacatttcgctttgaggaggcacgatctacggcacaaagcttattgttaattggttgttctggtagtgggaagacgacctctcttcatcgtattctagccacgtatcctcaggtgatttaccatcgtgaactcaatgtagagcaggtggtgtatttgaaaatagactgctcgcataatggttcgctaaaagaaatctgcttgaattttttcagagcgttggatcgagccttgggctcgaactatgagcgtcgttatggcttaaaacgtcatggtatagaaaccatgttggctttgatgtcgcaaatagccaatgcacatgctttagggttgttggttattgatgaaattcagcatttaagccgctctcgttcgggtggatctcaagagatgctgaacttttttgtgacgatggtgaatattattggcgtaccagtgatgttgattggtacccctaaagcacgagagatttttgaggctgatttgcggtctgcacgtagaggggcagggtttggagctatattctgggatcctatacaacaaacgcaacgtggaaagcccaatcaagagtggatcgcttttacggataatctttggcaattacagcttttacaacgcaaagatgcgctgttatcggatgaggtccgtgatgtgtggtatgagctaagccaaggagtgatggacattgtagtaaaactttttgtactcgctcagctccgtgcgctagctttaggcaatgagcgtattaccgctggtttattgcggcaagtgtatcaagatgagttaaagcctgtgcaccccatgctagaggcattacgctcgggtatcccagaacgcattgctcgttattctgatctagtcgttcccgagattgataaacggttaatccaacttcagctagatatcgcagcgatacaagaacaaacaccagaagaaaaagcccttcaagagttagataccgaagatcagcgtcatttatatctgatgctgaaagaggattacgattcaagcctgttaattcccactattaaaaaagcgtttagccagaatccaacgatgacaagacaaaagttactgcctcttgttttgcagtggttgatggaaggcgaaacggtagtgtcagaactagaaaagccctccaagagtaaaaaggtttcggctataaaggtagtcaagcccagcgactgggatagcttgcctgatacggatttacgttatatctattcacaacgccaacctgaaaaaaccatgcatgaacggttaaaagggaaaggggtaatagtggatatggcgagcttatttaaacaagcaggttagccatgagaaactttcctgttccgtactcgaatgagctgatttatagcactattgcacgggcaggcgtttatcaagggattgttagtcctaagcagctgttggatgaggtgtatggcaaccgcaaggtggtcgctaccttaggtctgccctcgcatttaggtgtgatagcaagacatctacatcaaacaggacgttacgctgttcagcagcttatttatgagcataccttattccctttatatgctccgtttgtaggcaaggagcgccgagacgaagctattcggttaatggagtaccaagcgcaaggtgcggtgcatttaatgctaggagtcgctgcttctagagttaagagcgataaccgctttagatactgccctgattgcgttgctcttcagctaaataggtatggggaagccttttggcaacgagattggtatttgcccgctttgccatattgtccaaaacacggtgctttagtcttctttgatagagctgtagatgatcaccgacatcaattttgggctttgggtcatactgagctgctttcagactaccccaaagactccctatctcaattaacagcactagctgcttatatagcccctctgttagatgctccacgagcgcaagagctttccccaagccttgagcagtggacgctgttttatcagcgcttagcgcaggatctagggctaaccaaaagcaagcacattcgtcatgacttggtggcggagagagtgaggcagacttttagtgatgaggcactagagaaactggatttaaagttggcagagaacaaggacacgtgttggctgaaaagtatattccgtaagcatagaaaagcctttagttatttacagcatagtattgtgtggcaagccttattgccaaaactaacggttatagaagcgctacagcaggcaagtgctcttactgagcactctataacgacaagacctgttagccagtctgtgcaacctaactctgaagatttatctgttaagcataaagactggcagcaactagtgcataaataccaaggaattaaggcggcaagacagtctttagagggtggggtgctatacgcttggctttaccgacatgacagggattggctagttcactggaatcaacagcatcaacaagagcgtctggcacccgcccctagagttgattggaaccaaagagatcgaattgctgtacgacaactattaagaatcataaagcgtctagatagtagccttgatcacccaagagcgacatcgagctggctgttaaagcaaactcctaacggaacctctcttgcaaaaaatctacagaaactgcctttggtagcgctttgcttaaagcgttactcagagagtgtggaagattatcaaattagacggattagccaagcttttattaagcttaaacaggaagatgttgagcttaggcgctggcgattattaagaagtgcaacgttatctaaagagcggataactgaggaagcacaaagattcttggaaatggtttatggggaagagtgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtc

SEQ ID NO: 2 - DNA, 4119 bp, artificial sequence
  Synthetic
tcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctgtgggcggacaaaatagttgggaactgggaggggtggaaatggagtttttaaggattatttagggaagagtgacaaaatagatgggaactgggtgtagcgtcgtaagctaatacgaaaattaaaaatgacaaaatagtttggaactagatttcacttatctggttaactaaggagatatacatatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgattcagtttacaactattctgtctagtttaagactttattgtcatagtttagatctattttgttcagtttaagactttattgtccgcccacaaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgc

SEQ ID NO: 3 - DNA, 3719 bp, artificial sequence
  Synthetic
ggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggcagatctcaattggatatcggccggccacgcgatcgctgacgtcggtaccctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactata

SEQ ID NO: 4 - DNA, 3781 bp, artificial sequence
  Synthetic
aacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggcagatctcaattggatatcggccggccacgcgatcgctgacgtcggtaccctcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcaga

SEQ ID NO: 5 - DNA, 2686 bp, artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 6 - DNA, 6858 bp, artificial sequence
  Synthetic
ttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagat

SEQ ID NO: 7 - DNA, 3630 bp, artificial sequence
  Synthetic
catcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgtttt

SEQ ID NO: 8 - DNA, 8388 bp, artificial sequence
  Synthetic
cgggatctcgacgctctcccttatgcgactcctgcattaggaaattaatacgactcactataggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtc

SEQ ID NO: 9 - DNA, 8428 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgagacctctggtctcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 10 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgttgtctgacacttgtcacaaaccgctaggaggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 11 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactgggaggattcataaagcattgtttgttggctgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 12 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgtcatcttcggctactttttctctgtcacagagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 13 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactatcccattacggtcaatccgccgtttgttccgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 14 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 15 - DNA, 6173 bp, artificial sequence
  Synthetic
gatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgc

SEQ ID NO: 16 - DNA, 5054 bp, artificial sequence
  Synthetic
cggataacaattcccctgtagaaataattttgtttaactttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgag

SEQ ID NO: 17 - DNA, 5869 bp, artificial sequence
  Synthetic
taatacgactcactataggggaattgtgagcggataacaattcccctgtagaaataattttgtttaactttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcgaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 18 - DNA, 7260 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 19 - DNA, 6551 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 20 - DNA, 7429 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgaataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 21 - DNA, 7843 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 22 - DNA, 6858 bp, artificial sequence
  Synthetic
tttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgcctttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatt

SEQ ID NO: 23 - DNA, 6858 bp, artificial sequence
  Synthetic
agttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaataaatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagac

SEQ ID NO: 24 - DNA, 6858 bp, artificial sequence
  Synthetic
taatacgactcactataggggaattgtgagcggataacaattcccctgtagaaataattttgtttaactttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgcgttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 25 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctggcgggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 26 - DNA, 7154 bp, artificial sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 27 - DNA, 9524 bp, artificial sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctaatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 28 - DNA, 10709 bp, artificial sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctaatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 29 - DNA, 7193 bp, artificial sequence
  Synthetic
ttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcatggagccacccgcagttcgaaaaaggtggcagcggttctatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaatagcattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaa

SEQ ID NO: 30 - DNA, 3739 bp, artificial sequence
  Synthetic
ggggaattgtgagcggataacaattcccctgtagaaataattttgtttaactttaataaggagatataccatgggtgaactgccgagtaggtagctgataacttacaggacgctttggcttcattgcttttcaggtgaactgccgagtaggtagctgataaccctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactata

SEQ ID NO: 31 - DNA, 3739 bp, artificial sequence
  Synthetic
actgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactatcccattacggtcaatccgccgtttgttccgtgaactgccgagtaggtagctgataaccctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcg

SEQ ID NO: 32 - DNA, 8158 bp, artificial sequence
  Synthetic
taatacgactcactataggggaattgtgagcggataacaattcccctgtagaaataattttgtttaactttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggcacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaat

SEQ ID NO: 33 - DNA, 7897 bp, artificial sequence
  Synthetic
aaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactatagggagaccagtctaggtctcggttttagagctagaaatagcaagttaaaataaggctagtccgttatcaacttgaaaaagtggcaccgagtcggtgctttttttggtagtgcagcgcgatcgtaatcaggatcccatggtacgcgtgctagaggcatcaaataaaacgaaaggctcagtcgaaagactgggcctttcgttttatctgttgtttgtcggtgaacgctctcctgagtaggacaaatggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactaatagcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcag

SEQ ID NO: 34 - DNA, 7897 bp, artificial sequence
  Synthetic
aaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactatagcggattgaccgtaatgggatgttttagagctagaaatagcaagttaaaataaggctagtccgttatcaacttgaaaaagtggcaccgagtcggtgctttttttggtagtgcagcgcgatcgtaatcaggatcccatggtacgcgtgctagaggcatcaaataaaacgaaaggctcagtcgaaagactgggcctttcgttttatctgttgtttgtcggtgaacgctctcctgagtaggacaaatggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactaatagcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcag

SEQ ID NO: 35 - DNA, 7897 bp, artificial sequence
  Synthetic
aaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactatagtgatttcagccgcgctgtacgttttagagctagaaatagcaagttaaaataaggctagtccgttatcaacttgaaaaagtggcaccgagtcggtgctttttttggtagtgcagcgcgatcgtaatcaggatcccatggtacgcgtgctagaggcatcaaataaaacgaaaggctcagtcgaaagactgggcctttcgttttatctgttgtttgtcggtgaacgctctcctgagtaggacaaatggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactaatagcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcag

SEQ ID NO: 36 - DNA, 7897 bp, artificial sequence
  Synthetic
ttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactatagtgatttcagccgcgctgtacgttttagagctagaaatagcaagttaaaataaggctagtccgttatcaacttgaaaaagtggcaccgagtcggtgctttttttggtagtgcagcgcgatcgtaatcaggatcccatggtacgcgtgctagaggcatcaaataaaacgaaaggctcagtcgaaagactgggcctttcgttttatctgttgtttgtcggtgaacgctctcctgagtaggacaaatggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggataagaaatactcaataggcttagctatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatgccattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactaatagcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggc

SEQ ID NO: 37 - DNA, 7945 bp, artificial sequence
  Synthetic
acaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggttcactgccgtataggcagctaagaaacgagacctcaattggtctccgttcactgccgtataggcagctaagaaaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgacctctcccctcccaacgcctacgtggcaggagcttcgccagttcatcgaatccttcatccaggagcgcctccagggcaagctggacaaactccaacccgacgaagacgacaagcgccagacattgctggccacccaccggcgggaggcctggctggccgatgccgcccggcgggttggccagttgcagttggtgacccacacgctcaagccgatccatcccgacgcccgcggcagcaacctgcacagcctgccgcaagcacccggccaaccgggcctcgccggttcccatgagctaggtgacaggctggtcagcgatgtggtgggcaatgccgcggcgctggacgtattcaagtttctcagtctccagtatcagggtaaaaatcttctgaactggctgacagaagacagtgccgaggcattacaggcgctgtccgataacgccgaacaggctcgcgaatggcggcaagcgttcatcggcatcacgaccgtcaaaggcgctcccgcgtcccacagcctggccaagcagttgtactttcccctgcccggttccggctaccacctgctagcaccgctgtttcccaccagtctggtgcatcacgtccacgctctgctccgcgaagcgcgcttcggcgacgcggccaaggcggcacgcgaagcgcgcagccgccaggagtcatggccccacggattcagcgagtaccccaacctggcgatccagaagttcggcggtaccaagccgcagaacatcagtcagttgaacaacgagcgccgtggcgagaactggttgctgccatcgcttccgccgaactggcaaaggcagaatgtaaacgcgccgatgcggcactcttcggtcttcgagcatgacttcggaagaactcctgaagtatcccgcctaacccgtaccctgcagcgttttcttgccaagacagtccataacaacctcgccatccgccagcggcgtgcccaattggtggcgcaaatctgcgacgaagccctgcaatacgccgcccgtctgcgcgaactggagcccggctggagcgcaacccccgggtgccaactgcatgacgcggagcagctctggctcgatccgttgcgcgcacagaccgatgagacgttcttgcagcgccgactacgaggtgactggcctgccgaggtcggaaatcgcttcgccaactggctgaaccgggcggtcagcagcgacagtcagatactgggtagcccggaagccgcccaatggagccaggagctgagcaaggaactgacgatgttcaaggagatactcgaagatgagcgtgactgataataacattggaagtggataacggatccgggccctgtacaagatcctgtaaaacgacggccagtgaattcactcgagttctagaaataattttgtttaactttaagaaggagatatagatcatgagcgtgactgatcccgaggcgctgctgttgctgccacgcctgtccatccagaacgccaacgccatttccagccccttgacctggggtttcccttcgcccggcgctttcaccggattcgtccatgccttgcagcgtcgagtcggaatctccctcgatatcgaactggacggtgtcggcatcgtctgtcaccgcttcgaagcgcagatatcgcaaccggccggcaagcgcaccaaggtcttcaacctgacccgcaatccgctgaaccgcgacggctccaccgcagccatcgtcgaagaaggtcgcgcccatctggaggtcagtctgctgctcggagtgcatggcgatggtctggacgatcaccccgcacaggaaatcgccaggcaggtacaggagcaggctggcgccatgcgcctcgccggtggcagcatcctgccctggtgcaatgagcgcttcccggctccgaacgccgaactgctgatgctgggtggcagcgacgaacagcggcgcaagaaccagcgccggcttacccgccgcctgctccccggcttcgccctggtgagtcgcgaggcgttgttgcaacaacatctggaaaccttgcgcaccacgctccccgaagccaccacgctcgatgcactgctcgatctttgtcgaatcaacttcgagcctcctgcaacctcgtccgaagaagaagcatcgccgcccgatgcagcctggcaagtgcgcgacaagcccggctggctggtgccgatcccggctggctacaacgccctgtcacccctgtacctccccggcgaagtgcgaaatgcccgtgatagagaaacaccgctgcgcttcgtcgaaaacctcttcggtctgggcgaatggctcagcccccatcgcgtcgccgcgttatcggacctgctttggtatcaccacgccgagcctgacaaagggctctaccgctggagcacaccccgtttcgtcgaacacgccatcgcataataataagatcccaactccataaggatccgcgatcgcagcggataacaatttcacatcctgcaggactcgagttctagaaataattttgtttaactttaagaaggagatatagatcatgtccaagccaatactgagcaccgcttccgtcctcgccttcgaacgtaagctcgacccttccgacgcccttatgagcgctggcgcctgggcgcaacgcgacgcctcgcaggaatggccggccgtgaccgtgcgcgagaagtccgtacgcggcaccatctccaaccgcctcaagaccaaggaccgtgacccggccaagctggacgcctcgatccagtcgcccaacctgcagacggtggacgtggccaacctgccgagcgacgccgacaccctcaaggtccgcttcaccctccgtgtgctcggcggcgccggaacaccgtctgcctgcaacgacgcggcctaccgtgacaagctgctgcaaacggtcgccacctacgtgaacgatcagggcttcgccgagctggctcgtcgttatgcgcacaacctggccaacgcccgcttcctgtggcgcaaccgggtgggcgcggaagcggtggaagtccgtatcaaccatatccgccagggcgaggtggctcgcgcctggcgcttcgacgccctggccatcggcttgcgcgacttcaaggccgacgccgaactggacgcgctcgccgaactgatcgccagcggcctctcaggcagtgggcatgtcctgctcgaagtggtcgccttcgcccgtatcggcgacggccaggaagtcttcccctcccaggaactgatcctcgacaaaggcgacaagaaaggccagaagagcaagaccctgtacagcgtacgcgatgccgcggccatccactcgcagaagatcggcaatgccctgcgcaccatcgatacgtggtatcccgacgaagatggcctcggccccatcgccgtggagccctacggctccgtcacatcccagggcaaagcctatcgccagcccaagcagaagctggacttctatacgctgctcgacaactgggtactgcgcgacgaggcgcccgccgtggagcaacagcattatgtgatcgccaacctgatccgtggcggcgtgttcggtgaagccgaagagaagtaataataagatcccaactccataaggatccgcgatcgcggcgcgcccgccagggttttcccagtcgcggccgccctgcaggactcgagttctagaaataattttgtttaactttaagaaggagatatagatcatggaccactacctcgacattcgcttgcgaccggacccggaatttcccccggcgcaactcatgagcgtgctcttcggcaagctccaccaggccctggtggcacagggcggggacaggatcggcgtgagcttccccgacctcgacgaaagccgctcccggctgggcgagcgcctgcgcattcatgcctcggcggacgaccttcgtgccctgctcgcccggccctggctggaagggttgcgggaccatctgcaattcggagaaccggcagtcgtgcctcaccccacaccgtaccgtcaggtcagtcgggttcaggcgaaaagcaatccggaacgcctgcggcggcggctcatgcgccggcacgatctgagtgaggaggaggctcggaaacgcattcccgatacggtcgcgagagccttggacctgcccttcgtcacgctacgcagccagagcaccggacagcacttccgtctcttcatccgccacgggccgttgcaggtgacggcagaggaaggaggattcacctgttacgggttgagcaaaggaggtttcgttccctggttctgataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagag

SEQ ID NO: 38 - DNA, 7957 bp, artificial sequence
  Synthetic
acaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggttcactgccgtataggcagctaagaaatatcccattacggtcaatccgccgtttgttccgttcactgccgtataggcagctaagaaaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgacctctcccctcccaacgcctacgtggcaggagcttcgccagttcatcgaatccttcatccaggagcgcctccagggcaagctggacaaactccaacccgacgaagacgacaagcgccagacattgctggccacccaccggcgggaggcctggctggccgatgccgcccggcgggttggccagttgcagttggtgacccacacgctcaagccgatccatcccgacgcccgcggcagcaacctgcacagcctgccgcaagcacccggccaaccgggcctcgccggttcccatgagctaggtgacaggctggtcagcgatgtggtgggcaatgccgcggcgctggacgtattcaagtttctcagtctccagtatcagggtaaaaatcttctgaactggctgacagaagacagtgccgaggcattacaggcgctgtccgataacgccgaacaggctcgcgaatggcggcaagcgttcatcggcatcacgaccgtcaaaggcgctcccgcgtcccacagcctggccaagcagttgtactttcccctgcccggttccggctaccacctgctagcaccgctgtttcccaccagtctggtgcatcacgtccacgctctgctccgcgaagcgcgcttcggcgacgcggccaaggcggcacgcgaagcgcgcagccgccaggagtcatggccccacggattcagcgagtaccccaacctggcgatccagaagttcggcggtaccaagccgcagaacatcagtcagttgaacaacgagcgccgtggcgagaactggttgctgccatcgcttccgccgaactggcaaaggcagaatgtaaacgcgccgatgcggcactcttcggtcttcgagcatgacttcggaagaactcctgaagtatcccgcctaacccgtaccctgcagcgttttcttgccaagacagtccataacaacctcgccatccgccagcggcgtgcccaattggtggcgcaaatctgcgacgaagccctgcaatacgccgcccgtctgcgcgaactggagcccggctggagcgcaacccccgggtgccaactgcatgacgcggagcagctctggctcgatccgttgcgcgcacagaccgatgagacgttcttgcagcgccgactacgaggtgactggcctgccgaggtcggaaatcgcttcgccaactggctgaaccgggcggtcagcagcgacagtcagatactgggtagcccggaagccgcccaatggagccaggagctgagcaaggaactgacgatgttcaaggagatactcgaagatgagcgtgactgataataacattggaagtggataacggatccgggccctgtacaagatcctgtaaaacgacggccagtgaattcactcgagttctagaaataattttgtttaactttaagaaggagatatagatcatgagcgtgactgatcccgaggcgctgctgttgctgccacgcctgtccatccagaacgccaacgccatttccagccccttgacctggggtttcccttcgcccggcgctttcaccggattcgtccatgccttgcagcgtcgagtcggaatctccctcgatatcgaactggacggtgtcggcatcgtctgtcaccgcttcgaagcgcagatatcgcaaccggccggcaagcgcaccaaggtcttcaacctgacccgcaatccgctgaaccgcgacggctccaccgcagccatcgtcgaagaaggtcgcgcccatctggaggtcagtctgctgctcggagtgcatggcgatggtctggacgatcaccccgcacaggaaatcgccaggcaggtacaggagcaggctggcgccatgcgcctcgccggtggcagcatcctgccctggtgcaatgagcgcttcccggctccgaacgccgaactgctgatgctgggtggcagcgacgaacagcggcgcaagaaccagcgccggcttacccgccgcctgctccccggcttcgccctggtgagtcgcgaggcgttgttgcaacaacatctggaaaccttgcgcaccacgctccccgaagccaccacgctcgatgcactgctcgatctttgtcgaatcaacttcgagcctcctgcaacctcgtccgaagaagaagcatcgccgcccgatgcagcctggcaagtgcgcgacaagcccggctggctggtgccgatcccggctggctacaacgccctgtcacccctgtacctccccggcgaagtgcgaaatgcccgtgatagagaaacaccgctgcgcttcgtcgaaaacctcttcggtctgggcgaatggctcagcccccatcgcgtcgccgcgttatcggacctgctttggtatcaccacgccgagcctgacaaagggctctaccgctggagcacaccccgtttcgtcgaacacgccatcgcataataataagatcccaactccataaggatccgcgatcgcagcggataacaatttcacatcctgcaggactcgagttctagaaataattttgtttaactttaagaaggagatatagatcatgtccaagccaatactgagcaccgcttccgtcctcgccttcgaacgtaagctcgacccttccgacgcccttatgagcgctggcgcctgggcgcaacgcgacgcctcgcaggaatggccggccgtgaccgtgcgcgagaagtccgtacgcggcaccatctccaaccgcctcaagaccaaggaccgtgacccggccaagctggacgcctcgatccagtcgcccaacctgcagacggtggacgtggccaacctgccgagcgacgccgacaccctcaaggtccgcttcaccctccgtgtgctcggcggcgccggaacaccgtctgcctgcaacgacgcggcctaccgtgacaagctgctgcaaacggtcgccacctacgtgaacgatcagggcttcgccgagctggctcgtcgttatgcgcacaacctggccaacgcccgcttcctgtggcgcaaccgggtgggcgcggaagcggtggaagtccgtatcaaccatatccgccagggcgaggtggctcgcgcctggcgcttcgacgccctggccatcggcttgcgcgacttcaaggccgacgccgaactggacgcgctcgccgaactgatcgccagcggcctctcaggcagtgggcatgtcctgctcgaagtggtcgccttcgcccgtatcggcgacggccaggaagtcttcccctcccaggaactgatcctcgacaaaggcgacaagaaaggccagaagagcaagaccctgtacagcgtacgcgatgccgcggccatccactcgcagaagatcggcaatgccctgcgcaccatcgatacgtggtatcccgacgaagatggcctcggccccatcgccgtggagccctacggctccgtcacatcccagggcaaagcctatcgccagcccaagcagaagctggacttctatacgctgctcgacaactgggtactgcgcgacgaggcgcccgccgtggagcaacagcattatgtgatcgccaacctgatccgtggcggcgtgttcggtgaagccgaagagaagtaataataagatcccaactccataaggatccgcgatcgcggcgcgcccgccagggttttcccagtcgcggccgccctgcaggactcgagttctagaaataattttgtttaactttaagaaggagatatagatcatggaccactacctcgacattcgcttgcgaccggacccggaatttcccccggcgcaactcatgagcgtgctcttcggcaagctccaccaggccctggtggcacagggcggggacaggatcggcgtgagcttccccgacctcgacgaaagccgctcccggctgggcgagcgcctgcgcattcatgcctcggcggacgaccttcgtgccctgctcgcccggccctggctggaagggttgcgggaccatctgcaattcggagaaccggcagtcgtgcctcaccccacaccgtaccgtcaggtcagtcgggttcaggcgaaaagcaatccggaacgcctgcggcggcggctcatgcgccggcacgatctgagtgaggaggaggctcggaaacgcattcccgatacggtcgcgagagccttggacctgcccttcgtcacgctacgcagccagagcaccggacagcacttccgtctcttcatccgccacgggccgttgcaggtgacggcagaggaaggaggattcacctgttacgggttgagcaaaggaggtttcgttccctggttctgataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagag

SEQ ID NO: 39 - DNA, 7957 bp, artificial sequence
  Synthetic
acaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggttcactgccgtataggcagctaagaaaagtacagcgcggctgaaatcatcattaaagcggttcactgccgtataggcagctaagaaaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgacctctcccctcccaacgcctacgtggcaggagcttcgccagttcatcgaatccttcatccaggagcgcctccagggcaagctggacaaactccaacccgacgaagacgacaagcgccagacattgctggccacccaccggcgggaggcctggctggccgatgccgcccggcgggttggccagttgcagttggtgacccacacgctcaagccgatccatcccgacgcccgcggcagcaacctgcacagcctgccgcaagcacccggccaaccgggcctcgccggttcccatgagctaggtgacaggctggtcagcgatgtggtgggcaatgccgcggcgctggacgtattcaagtttctcagtctccagtatcagggtaaaaatcttctgaactggctgacagaagacagtgccgaggcattacaggcgctgtccgataacgccgaacaggctcgcgaatggcggcaagcgttcatcggcatcacgaccgtcaaaggcgctcccgcgtcccacagcctggccaagcagttgtactttcccctgcccggttccggctaccacctgctagcaccgctgtttcccaccagtctggtgcatcacgtccacgctctgctccgcgaagcgcgcttcggcgacgcggccaaggcggcacgcgaagcgcgcagccgccaggagtcatggccccacggattcagcgagtaccccaacctggcgatccagaagttcggcggtaccaagccgcagaacatcagtcagttgaacaacgagcgccgtggcgagaactggttgctgccatcgcttccgccgaactggcaaaggcagaatgtaaacgcgccgatgcggcactcttcggtcttcgagcatgacttcggaagaactcctgaagtatcccgcctaacccgtaccctgcagcgttttcttgccaagacagtccataacaacctcgccatccgccagcggcgtgcccaattggtggcgcaaatctgcgacgaagccctgcaatacgccgcccgtctgcgcgaactggagcccggctggagcgcaacccccgggtgccaactgcatgacgcggagcagctctggctcgatccgttgcgcgcacagaccgatgagacgttcttgcagcgccgactacgaggtgactggcctgccgaggtcggaaatcgcttcgccaactggctgaaccgggcggtcagcagcgacagtcagatactgggtagcccggaagccgcccaatggagccaggagctgagcaaggaactgacgatgttcaaggagatactcgaagatgagcgtgactgataataacattggaagtggataacggatccgggccctgtacaagatcctgtaaaacgacggccagtgaattcactcgagttctagaaataattttgtttaactttaagaaggagatatagatcatgagcgtgactgatcccgaggcgctgctgttgctgccacgcctgtccatccagaacgccaacgccatttccagccccttgacctggggtttcccttcgcccggcgctttcaccggattcgtccatgccttgcagcgtcgagtcggaatctccctcgatatcgaactggacggtgtcggcatcgtctgtcaccgcttcgaagcgcagatatcgcaaccggccggcaagcgcaccaaggtcttcaacctgacccgcaatccgctgaaccgcgacggctccaccgcagccatcgtcgaagaaggtcgcgcccatctggaggtcagtctgctgctcggagtgcatggcgatggtctggacgatcaccccgcacaggaaatcgccaggcaggtacaggagcaggctggcgccatgcgcctcgccggtggcagcatcctgccctggtgcaatgagcgcttcccggctccgaacgccgaactgctgatgctgggtggcagcgacgaacagcggcgcaagaaccagcgccggcttacccgccgcctgctccccggcttcgccctggtgagtcgcgaggcgttgttgcaacaacatctggaaaccttgcgcaccacgctccccgaagccaccacgctcgatgcactgctcgatctttgtcgaatcaacttcgagcctcctgcaacctcgtccgaagaagaagcatcgccgcccgatgcagcctggcaagtgcgcgacaagcccggctggctggtgccgatcccggctggctacaacgccctgtcacccctgtacctccccggcgaagtgcgaaatgcccgtgatagagaaacaccgctgcgcttcgtcgaaaacctcttcggtctgggcgaatggctcagcccccatcgcgtcgccgcgttatcggacctgctttggtatcaccacgccgagcctgacaaagggctctaccgctggagcacaccccgtttcgtcgaacacgccatcgcataataataagatcccaactccataaggatccgcgatcgcagcggataacaatttcacatcctgcaggactcgagttctagaaataattttgtttaactttaagaaggagatatagatcatgtccaagccaatactgagcaccgcttccgtcctcgccttcgaacgtaagctcgacccttccgacgcccttatgagcgctggcgcctgggcgcaacgcgacgcctcgcaggaatggccggccgtgaccgtgcgcgagaagtccgtacgcggcaccatctccaaccgcctcaagaccaaggaccgtgacccggccaagctggacgcctcgatccagtcgcccaacctgcagacggtggacgtggccaacctgccgagcgacgccgacaccctcaaggtccgcttcaccctccgtgtgctcggcggcgccggaacaccgtctgcctgcaacgacgcggcctaccgtgacaagctgctgcaaacggtcgccacctacgtgaacgatcagggcttcgccgagctggctcgtcgttatgcgcacaacctggccaacgcccgcttcctgtggcgcaaccgggtgggcgcggaagcggtggaagtccgtatcaaccatatccgccagggcgaggtggctcgcgcctggcgcttcgacgccctggccatcggcttgcgcgacttcaaggccgacgccgaactggacgcgctcgccgaactgatcgccagcggcctctcaggcagtgggcatgtcctgctcgaagtggtcgccttcgcccgtatcggcgacggccaggaagtcttcccctcccaggaactgatcctcgacaaaggcgacaagaaaggccagaagagcaagaccctgtacagcgtacgcgatgccgcggccatccactcgcagaagatcggcaatgccctgcgcaccatcgatacgtggtatcccgacgaagatggcctcggccccatcgccgtggagccctacggctccgtcacatcccagggcaaagcctatcgccagcccaagcagaagctggacttctatacgctgctcgacaactgggtactgcgcgacgaggcgcccgccgtggagcaacagcattatgtgatcgccaacctgatccgtggcggcgtgttcggtgaagccgaagagaagtaataataagatcccaactccataaggatccgcgatcgcggcgcgcccgccagggttttcccagtcgcggccgccctgcaggactcgagttctagaaataattttgtttaactttaagaaggagatatagatcatggaccactacctcgacattcgcttgcgaccggacccggaatttcccccggcgcaactcatgagcgtgctcttcggcaagctccaccaggccctggtggcacagggcggggacaggatcggcgtgagcttccccgacctcgacgaaagccgctcccggctgggcgagcgcctgcgcattcatgcctcggcggacgaccttcgtgccctgctcgcccggccctggctggaagggttgcgggaccatctgcaattcggagaaccggcagtcgtgcctcaccccacaccgtaccgtcaggtcagtcgggttcaggcgaaaagcaatccggaacgcctgcggcggcggctcatgcgccggcacgatctgagtgaggaggaggctcggaaacgcattcccgatacggtcgcgagagccttggacctgcccttcgtcacgctacgcagccagagcaccggacagcacttccgtctcttcatccgccacgggccgttgcaggtgacggcagaggaaggaggattcacctgttacgggttgagcaaaggaggtttcgttccctggttctgataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagag

SEQ ID NO: 40 - DNA, 6591 bp, artificial sequence
  Synthetic
ttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgaacatcctgctggtgtcgcaatgcgaaaagcgcgccctgagcgaaacccgccgcattctcgaccagttcgccgagcgccgcggcgaacggacctggcaaacgcccatcactcaagccggactggataccctgcgacgcctgctgaagaaaagcgcacggcgcaacaccgccgtagcctgtcactggatccgcggccgcgaccacagcgaactgctgtggatcgtcggtgatgccagccgcttcaacgcccagggtgcggtgccgaccaacaggacctgccgcgacatcctgcgcaaggaagacgagaacgactggcacagcgccgaggacatccgcctgctgacggtgatggcagcgctgttccacgatatcggcaaggccagccaggccttccaggccaaactgcggaaccgcggcaaaccgatggccgatgcctatcgtcacgaatgggtatcactgcgcctgttcgaagccttcgttggcccaggcagcagcgacgaggactggctgaggcgcctggcggacaagcgagagacgggcgatgcctggctgtcgcaactggccagggacgaccggcaatccgcgccacccggcccgttccagaaaagccggctaccgccgctcgcccaggcggtcggctggttgatcgtcagccatcatcgcctgcccaacggggaccatcgcggcagcgcctcgctggcacgcttgccggcccccatccagagccaatggtgcggcgcacgcgacgcagacgcaaaagaaaaggccgcctgctggcagttcccccacggcctgcccttcgccagcgcccattggcgcgccaggacagcgctatgcgcgcagagcatgctcgagcgtcccggcctgctggctcggggaccggccttgttgcatgattcctacgtcatgcatgtgtcccgactgatcctgatgctcgcggaccaccactattccagtctccctgccgactcccggctgggcgacccgaacttccccttgcacgccaacaccgaccgggacagcggcaaactaaagcagcgcctggacgaacacctgctcggcgtcgccctgcacagtcgcaagctcgccggcaccctgccacgcctggagcgacaactaccgcgccttgcccggcacaagggcttcacccgccgggtcgagcagccgcgcttccgctggcaggacaaggcctacgactgcgcgatggcctgccgcgagcaggctatggagcatggattcttcggcctcaacctggcgtcgaccggttgcggtaagaccctcgccaacggccgtatcctgtatgcgctggccgatccgcaacgcggcgcgcgtttcagcatcgctctcggcctgcgcagcttgaccctgcaaaccgggcaggcctaccgcgagcggctcggcctgggcgacgacgacctcgctatcctggtcggcggcagcgccgcccgcgaactgttcgaaaagcagcaggagcgcctggagcgcagcggtagcgagtcagcccaggagctgctggcggaaaacagccatgtacacttcgccggcacgctcgaggacggccctctacgcgagtggctcggcaggaacagcgcgggaaaccgcctactccaggcgcccatcctggcctgcaccatcgaccacctgatgcccgccagcgaaagcctgcgcggcggacaccagatagcgccactgctccgcctgatgacttccgacctggtgctcgacgaggtcgacgacttcgatatcgacgacctgcccgccctgtcgcggctggtgcactgggccggcctgttcggcagccgcgtgctgctctcctccgcgaccctgccgccggccttggtgcagggcctgttcgaggcctatcgcagcggccgggaaatcttccagcgccatcgtggcgctcccggacgcgctacggaaatccgctgtgcctggttcgacgagttctccagccaatccagcgcccacggcgccgtaacctccttcagcgaagcgcatgcgaccttcgtcgcccagcgtctggcgaagctcgagcaactgccgccacgtcgccaggcgcagctatgcaccgtgcatgccgctggcgaggcccgtcccgcgctgtgccgcgagttggccgggcagatgaatacctggatggctgacctgcatcgctgccatcacaccgaacaccaaggacgtcgcatcagtttcggcctgctacggctggccaacatcgaacccctgatcgaactggcccaggccatcctcgcccagggtgcgcccgaggggttgcatgtccatctgtgtgtctaccattcgcggcatccccttctggtccgctcggccatcgagcgacaactcgatgaactgctgaagcgttcggacgacgacgccgccgcgctgttcgctcgtccgacgctggccaaggcgctccaggccagcacggagcgggatcatctgttcgtcgtactcgcctcgccggtggcggaggtcggtcgcgaccacgattacgactgggccatcgtcgaaccctcctccatgcgctcgatcatccagttggccgggcgaatccgccgccatcgctccggcttcagcggcgaggccaacctatacctgctatcgcgcaatatccgctcgctggaagggcagaatccggcgttccagcggcccggcttcgagacccccgacttccctcttgacagccacgacctgcacgacctgctcgaccccgccctactcgcccgcatcgacgccagcccacgaatcgtcgaaccgttcccactgttcccacgcagccggttggtcgacctggaacaccgacgcctgcgcgcgctgatgcttgccgacgacccaccgtcgtccctgctcggcgtaccgctctggtggcaaaccccggcatcgctcagcggcgccctgcaaaccagccaaccatttcgcgcaggcgccaaggagcgatgctacgccctgctgccggacgaggacgacgaggagcgcttgcatttcagccgctacgaagaagggacctggagcaaccaggacaacctgttgcgcaacctcgacctcacctatggcccgcgcatccagacatggggcacggtcaactatcgggaggagctagtcgcaatggccggccgcgaggacctcgacctgcgtcaatgcgccatgcgctacggcgaggtgagattgcgagaaaacacccagggatggagctaccacccttatttggggttcaagaaatacaactgataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgtt

SEQ ID NO: 41 - DNA, 9169 bp, artificial sequence
  Synthetic
gttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactatagtgatttcagccgcgctgtacgttttagagctagaaatagcaagttaaaataaggctagtccgttatcaacttgaaaaagtggcaccgagtcggtgctttttttggtagtgcagcgcgatcgtaatcaggatcccatggtacgcgtgctagaggcatcaaataaaacgaaaggctcagtcgaaagactgggcctttcgttttatctgttgtttgtcggtgaacgctctcctgagtaggacaaatggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtccggtagcgaaacgccggggacttctgaatctgctactccggaaagcggaggctctggctcgtcaggaggttcaggaagttcaggcggtatggataagaaatactcaataggcttagctatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatgccattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactaatagcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcg

SEQ ID NO: 42 - DNA, 9169 bp, artificial sequence
  Synthetic
tttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactatagtgatttcagccgcgctgtacgttttagagctagaaatagcaagttaaaataaggctagtccgttatcaacttgaaaaagtggcaccgagtcggtgctttttttggtagtgcagcgcgatcgtaatcaggatcccatggtacgcgtgctagaggcatcaaataaaacgaaaggctcagtcgaaagactgggcctttcgttttatctgttgtttgtcggtgaacgctctcctgagtaggacaaatggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggataagaaatactcaataggcttagctatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatgccattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactccggtagcgaaacgccggggacttctgaatctgctactccggaaagcggaggctctggctcgtcaggaggttcaggaagttcaggcggtatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaatagcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactt

SEQ ID NO: 43 - DNA, 9229 bp, artificial sequence
  Synthetic
attcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggttcactgccgtataggcagctaagaaaagtacagcgcggctgaaatcatcattaaagcggttcactgccgtataggcagctaagaaaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtccggtagcgaaacgccggggacttctgaatctgctactccggaaagcggaggctctggctcgtcaggaggttcaggaagttcaggcggtatgacctctcccctcccaacgcctacgtggcaggagcttcgccagttcatcgaatccttcatccaggagcgcctccagggcaagctggacaaactccaacccgacgaagacgacaagcgccagacattgctggccacccaccggcgggaggcctggctggccgatgccgcccggcgggttggccagttgcagttggtgacccacacgctcaagccgatccatcccgacgcccgcggcagcaacctgcacagcctgccgcaagcacccggccaaccgggcctcgccggttcccatgagctaggtgacaggctggtcagcgatgtggtgggcaatgccgcggcgctggacgtattcaagtttctcagtctccagtatcagggtaaaaatcttctgaactggctgacagaagacagtgccgaggcattacaggcgctgtccgataacgccgaacaggctcgcgaatggcggcaagcgttcatcggcatcacgaccgtcaaaggcgctcccgcgtcccacagcctggccaagcagttgtactttcccctgcccggttccggctaccacctgctagcaccgctgtttcccaccagtctggtgcatcacgtccacgctctgctccgcgaagcgcgcttcggcgacgcggccaaggcggcacgcgaagcgcgcagccgccaggagtcatggccccacggattcagcgagtaccccaacctggcgatccagaagttcggcggtaccaagccgcagaacatcagtcagttgaacaacgagcgccgtggcgagaactggttgctgccatcgcttccgccgaactggcaaaggcagaatgtaaacgcgccgatgcggcactcttcggtcttcgagcatgacttcggaagaactcctgaagtatcccgcctaacccgtaccctgcagcgttttcttgccaagacagtccataacaacctcgccatccgccagcggcgtgcccaattggtggcgcaaatctgcgacgaagccctgcaatacgccgcccgtctgcgcgaactggagcccggctggagcgcaacccccgggtgccaactgcatgacgcggagcagctctggctcgatccgttgcgcgcacagaccgatgagacgttcttgcagcgccgactacgaggtgactggcctgccgaggtcggaaatcgcttcgccaactggctgaaccgggcggtcagcagcgacagtcagatactgggtagcccggaagccgcccaatggagccaggagctgagcaaggaactgacgatgttcaaggagatactcgaagatgagcgtgactgataataacattggaagtggataacggatccgggccctgtacaagatcctgtaaaacgacggccagtgaattcactcgagttctagaaataattttgtttaactttaagaaggagatatagatcatgagcgtgactgatcccgaggcgctgctgttgctgccacgcctgtccatccagaacgccaacgccatttccagccccttgacctggggtttcccttcgcccggcgctttcaccggattcgtccatgccttgcagcgtcgagtcggaatctccctcgatatcgaactggacggtgtcggcatcgtctgtcaccgcttcgaagcgcagatatcgcaaccggccggcaagcgcaccaaggtcttcaacctgacccgcaatccgctgaaccgcgacggctccaccgcagccatcgtcgaagaaggtcgcgcccatctggaggtcagtctgctgctcggagtgcatggcgatggtctggacgatcaccccgcacaggaaatcgccaggcaggtacaggagcaggctggcgccatgcgcctcgccggtggcagcatcctgccctggtgcaatgagcgcttcccggctccgaacgccgaactgctgatgctgggtggcagcgacgaacagcggcgcaagaaccagcgccggcttacccgccgcctgctccccggcttcgccctggtgagtcgcgaggcgttgttgcaacaacatctggaaaccttgcgcaccacgctccccgaagccaccacgctcgatgcactgctcgatctttgtcgaatcaacttcgagcctcctgcaacctcgtccgaagaagaagcatcgccgcccgatgcagcctggcaagtgcgcgacaagcccggctggctggtgccgatcccggctggctacaacgccctgtcacccctgtacctccccggcgaagtgcgaaatgcccgtgatagagaaacaccgctgcgcttcgtcgaaaacctcttcggtctgggcgaatggctcagcccccatcgcgtcgccgcgttatcggacctgctttggtatcaccacgccgagcctgacaaagggctctaccgctggagcacaccccgtttcgtcgaacacgccatcgcataataataagatcccaactccataaggatccgcgatcgcagcggataacaatttcacatcctgcaggactcgagttctagaaataattttgtttaactttaagaaggagatatagatcatgtccaagccaatactgagcaccgcttccgtcctcgccttcgaacgtaagctcgacccttccgacgcccttatgagcgctggcgcctgggcgcaacgcgacgcctcgcaggaatggccggccgtgaccgtgcgcgagaagtccgtacgcggcaccatctccaaccgcctcaagaccaaggaccgtgacccggccaagctggacgcctcgatccagtcgcccaacctgcagacggtggacgtggccaacctgccgagcgacgccgacaccctcaaggtccgcttcaccctccgtgtgctcggcggcgccggaacaccgtctgcctgcaacgacgcggcctaccgtgacaagctgctgcaaacggtcgccacctacgtgaacgatcagggcttcgccgagctggctcgtcgttatgcgcacaacctggccaacgcccgcttcctgtggcgcaaccgggtgggcgcggaagcggtggaagtccgtatcaaccatatccgccagggcgaggtggctcgcgcctggcgcttcgacgccctggccatcggcttgcgcgacttcaaggccgacgccgaactggacgcgctcgccgaactgatcgccagcggcctctcaggcagtgggcatgtcctgctcgaagtggtcgccttcgcccgtatcggcgacggccaggaagtcttcccctcccaggaactgatcctcgacaaaggcgacaagaaaggccagaagagcaagaccctgtacagcgtacgcgatgccgcggccatccactcgcagaagatcggcaatgccctgcgcaccatcgatacgtggtatcccgacgaagatggcctcggccccatcgccgtggagccctacggctccgtcacatcccagggcaaagcctatcgccagcccaagcagaagctggacttctatacgctgctcgacaactgggtactgcgcgacgaggcgcccgccgtggagcaacagcattatgtgatcgccaacctgatccgtggcggcgtgttcggtgaagccgaagagaagtaataataagatcccaactccataaggatccgcgatcgcggcgcgcccgccagggttttcccagtcgcggccgccctgcaggactcgagttctagaaataattttgtttaactttaagaaggagatatagatcatggaccactacctcgacattcgcttgcgaccggacccggaatttcccccggcgcaactcatgagcgtgctcttcggcaagctccaccaggccctggtggcacagggcggggacaggatcggcgtgagcttccccgacctcgacgaaagccgctcccggctgggcgagcgcctgcgcattcatgcctcggcggacgaccttcgtgccctgctcgcccggccctggctggaagggttgcgggaccatctgcaattcggagaaccggcagtcgtgcctcaccccacaccgtaccgtcaggtcagtcgggttcaggcgaaaagcaatccggaacgcctgcggcggcggctcatgcgccggcacgatctgagtgaggaggaggctcggaaacgcattcccgatacggtcgcgagagccttggacctgcccttcgtcacgctacgcagccagagcaccggacagcacttccgtctcttcatccgccacgggccgttgcaggtgacggcagaggaaggaggattcacctgttacgggttgagcaaaggaggtttcgttccctggttctgataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgta

SEQ ID NO: 44 - DNA, 9229 bp, artificial sequence
  Synthetic
acaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggttcactgccgtataggcagctaagaaaagtacagcgcggctgaaatcatcattaaagcggttcactgccgtataggcagctaagaaaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgacctctcccctcccaacgcctacgtggcaggagcttcgccagttcatcgaatccttcatccaggagcgcctccagggcaagctggacaaactccaacccgacgaagacgacaagcgccagacattgctggccacccaccggcgggaggcctggctggccgatgccgcccggcgggttggccagttgcagttggtgacccacacgctcaagccgatccatcccgacgcccgcggcagcaacctgcacagcctgccgcaagcacccggccaaccgggcctcgccggttcccatgagctaggtgacaggctggtcagcgatgtggtgggcaatgccgcggcgctggacgtattcaagtttctcagtctccagtatcagggtaaaaatcttctgaactggctgacagaagacagtgccgaggcattacaggcgctgtccgataacgccgaacaggctcgcgaatggcggcaagcgttcatcggcatcacgaccgtcaaaggcgctcccgcgtcccacagcctggccaagcagttgtactttcccctgcccggttccggctaccacctgctagcaccgctgtttcccaccagtctggtgcatcacgtccacgctctgctccgcgaagcgcgcttcggcgacgcggccaaggcggcacgcgaagcgcgcagccgccaggagtcatggccccacggattcagcgagtaccccaacctggcgatccagaagttcggcggtaccaagccgcagaacatcagtcagttgaacaacgagcgccgtggcgagaactggttgctgccatcgcttccgccgaactggcaaaggcagaatgtaaacgcgccgatgcggcactcttcggtcttcgagcatgacttcggaagaactcctgaagtatcccgcctaacccgtaccctgcagcgttttcttgccaagacagtccataacaacctcgccatccgccagcggcgtgcccaattggtggcgcaaatctgcgacgaagccctgcaatacgccgcccgtctgcgcgaactggagcccggctggagcgcaacccccgggtgccaactgcatgacgcggagcagctctggctcgatccgttgcgcgcacagaccgatgagacgttcttgcagcgccgactacgaggtgactggcctgccgaggtcggaaatcgcttcgccaactggctgaaccgggcggtcagcagcgacagtcagatactgggtagcccggaagccgcccaatggagccaggagctgagcaaggaactgacgatgttcaaggagatactcgaagatgagcgtgactgataataacattggaagtggataacggatccgggccctgtacaagatcctgtaaaacgacggccagtgaattcactcgagttctagaaataattttgtttaactttaagaaggagatatagatcatgagcgtgactgatcccgaggcgctgctgttgctgccacgcctgtccatccagaacgccaacgccatttccagccccttgacctggggtttcccttcgcccggcgctttcaccggattcgtccatgccttgcagcgtcgagtcggaatctccctcgatatcgaactggacggtgtcggcatcgtctgtcaccgcttcgaagcgcagatatcgcaaccggccggcaagcgcaccaaggtcttcaacctgacccgcaatccgctgaaccgcgacggctccaccgcagccatcgtcgaagaaggtcgcgcccatctggaggtcagtctgctgctcggagtgcatggcgatggtctggacgatcaccccgcacaggaaatcgccaggcaggtacaggagcaggctggcgccatgcgcctcgccggtggcagcatcctgccctggtgcaatgagcgcttcccggctccgaacgccgaactgctgatgctgggtggcagcgacgaacagcggcgcaagaaccagcgccggcttacccgccgcctgctccccggcttcgccctggtgagtcgcgaggcgttgttgcaacaacatctggaaaccttgcgcaccacgctccccgaagccaccacgctcgatgcactgctcgatctttgtcgaatcaacttcgagcctcctgcaacctcgtccgaagaagaagcatcgccgcccgatgcagcctggcaagtgcgcgacaagcccggctggctggtgccgatcccggctggctacaacgccctgtcacccctgtacctccccggcgaagtgcgaaatgcccgtgatagagaaacaccgctgcgcttcgtcgaaaacctcttcggtctgggcgaatggctcagcccccatcgcgtcgccgcgttatcggacctgctttggtatcaccacgccgagcctgacaaagggctctaccgctggagcacaccccgtttcgtcgaacacgccatcgcataataataagatcccaactccataaggatccgcgatcgcagcggataacaatttcacatcctgcaggactcgagttctagaaataattttgtttaactttaagaaggagatatagatcatgtccaagccaatactgagcaccgcttccgtcctcgccttcgaacgtaagctcgacccttccgacgcccttatgagcgctggcgcctgggcgcaacgcgacgcctcgcaggaatggccggccgtgaccgtgcgcgagaagtccgtacgcggcaccatctccaaccgcctcaagaccaaggaccgtgacccggccaagctggacgcctcgatccagtcgcccaacctgcagacggtggacgtggccaacctgccgagcgacgccgacaccctcaaggtccgcttcaccctccgtgtgctcggcggcgccggaacaccgtctgcctgcaacgacgcggcctaccgtgacaagctgctgcaaacggtcgccacctacgtgaacgatcagggcttcgccgagctggctcgtcgttatgcgcacaacctggccaacgcccgcttcctgtggcgcaaccgggtgggcgcggaagcggtggaagtccgtatcaaccatatccgccagggcgaggtggctcgcgcctggcgcttcgacgccctggccatcggcttgcgcgacttcaaggccgacgccgaactggacgcgctcgccgaactgatcgccagcggcctctcaggcagtgggcatgtcctgctcgaagtggtcgccttcgcccgtatcggcgacggccaggaagtcttcccctcccaggaactgatcctcgacaaaggcgacaagaaaggccagaagagcaagaccctgtacagcgtacgcgatgccgcggccatccactcgcagaagatcggcaatgccctgcgcaccatcgatacgtggtatcccgacgaagatggcctcggccccatcgccgtggagccctacggctccgtcacatcccagggcaaagcctatcgccagcccaagcagaagctggacttctatacgctgctcgacaactgggtactgcgcgacgaggcgcccgccgtggagcaacagcattatgtgatcgccaacctgatccgtggcggcgtgttcggtgaagccgaagagaagtaataataagatcccaactccataaggatccgcgatcgcggcgcgcccgccagggttttcccagtcgcggccgccctgcaggactcgagttctagaaataattttgtttaactttaagaaggagatatagatcatggaccactacctcgacattcgcttgcgaccggacccggaatttcccccggcgcaactcatgagcgtgctcttcggcaagctccaccaggccctggtggcacagggcggggacaggatcggcgtgagcttccccgacctcgacgaaagccgctcccggctgggcgagcgcctgcgcattcatgcctcggcggacgaccttcgtgccctgctcgcccggccctggctggaagggttgcgggaccatctgcaattcggagaaccggcagtcgtgcctcaccccacaccgtaccgtcaggtcagtcgggttcaggcgaaaagcaatccggaacgcctgcggcggcggctcatgcgccggcacgatctgagtgaggaggaggctcggaaacgcattcccgatacggtcgcgagagccttggacctgcccttcgtcacgctacgcagccagagcaccggacagcacttccgtctcttcatccgccacgggccgttgcaggtgacggcagaggaaggaggattcacctgttacgggttgagcaaaggaggtttcgttccctggttctccggtagcgaaacgccggggacttctgaatctgctactccggaaagcggaggctctggctcgtcaggaggttcaggaagttcaggcggtatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtgataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagag

SEQ ID NO: 45 - DNA, 8532 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtccggtagcgaaacgccggggacttctgaatctgctactccggaaagcggaggctctggctcgtcaggaggttcaggaagttcaggcggtatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 46 - DNA, 8535 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctccggtagcgaaacgccggggacttctgaatctgctactccggaaagcggaggctctggctcgtcaggaggttcaggaagttcaggcggtatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaatgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 47 - DNA, 2946 bp, artificial sequence
  Synthetic
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccgagtctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 48 - DNA, 2987 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttcgctctggagtgaataccaccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 49 - DNA, 3050 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacccgctctggagtgaataccaccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 50 - DNA, 3177 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtacgctctggagtgaataccaccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 51 - DNA, 3428 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 52 - DNA, 4658 bp, artificial sequence
  Synthetic
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccgggcggcctattggttaaaaaatgagctgatttaacaaaaatttaacgcgaattaattgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatagcactggacatcacgaagcttaccggtagccaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagcagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 53 - DNA, 5915 bp, artificial sequence
  Synthetic
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcactgggccaggattctcctcgacgtcaccgcatgttagcagacttcctctgccctctccactgccgaattcctttttcttttttgcctggccggcctttttcgtggccgccggccttttgtcgcctcccagctgagacaggtcgatccgtgtctcgtacaggccggtgatgctctggtggatcagggtggcgtccagcacctctttggtgctggtgtacctcttccggtcgatggtggtgtcaaagtacttgaaggcggcaggggctcccagattggtcagggtaaacaggtggatgatattctcggcctgctctctgatgggcttatcccggtgcttgttgtaggcggacagcactttgtccagattagcgtcggccaggatcactctcttggagaactcgctgatctgctcgatgatctcgtccaggtagtgcttgtgctgttccacaaacagctgtttctgctcattatcctcgggggagcccttcagcttctcatagtggctggccaggtacaggaagttcacatatttggagggcagggccagttcgtttcccttctgcagttcgccggcagaggccagcattctcttccggccgttttccagctcgaacagggagtacttaggcagcttgatgatcaggtcctttttcacttctttgtagcccttggcttccagaaagtcgatgggattcttctcgaagctgcttctttccatgatggtgatccccagcagctctttcacactcttcagtttcttggacttgcccttttccactttggccaccaccagcacagaataggccacggtggggctgtcgaagccgccgtacttcttagggtcccagtccttctttctggcgatcagcttatcgctgttcctcttgggcaggatagactctttgctgaagccgcctgtctgcacctcggtctttttcacgatattcacttggggcatgctcagcactttccgcacggtggcaaaatcccggcccttatcccacacgatctccccggtttcgccgtttgtctcgatcagaggccgcttccggatctcgccgttggccagggtaatctcggtcttgaaaaagttcatgatgttgctgtagaagaagtacttggcggtagccttgccgatttcctgctcgctcttggcgatcatcttccgcacgtcgtacaccttgtagtcgccgtacacgaactcgctttccagcttagggtactttttgatcagggcggttcccacgacggcgttcaggtaggcgtcgtgggcgtggtggtagttgttgatctcgcgcactttgtaaaactggaaatccttccggaaatcggacaccagcttggacttcagggtgatcactttcacttcccggatcagcttgtcattctcgtcgtacttagtgttcatccgggagtccaggatctgtgccacgtgctttgtgatctgccgggtttccaccagctgtctcttgatgaagccggccttatccagttcgctcaggccgcctctctcggccttggtcagattgtcgaactttctctgggtaatcagcttggcgttcagatggggttttcctcgaacagctggttgtaggtctgcaccagctggatgaacagcttgtccacgtcgctgttgtcggggttcaggtcgccctcgatcaggaagtggccccggaacttgatcatgtgggccagggccagatagatcagccgcaggtcggccttgtcggtgctgtccaccagtttctttctcaggtggtagatggtggggtacttctcgtggtaggccacctcgtccacgatgttgccgaagatggggtgccgctcgtgcttcttatcctcttccaccaggaaggactcttccagtctgtggaagaagctgtcgtccaccttggccatctcgttgctgaagatctcttgcagatagcagatccggttcttccgtctggtgtatcttcttctggcggttctcttcagccgggtggcctcggctgtttcgccgctgtcgaacagcagggctccgatcaggttcttcttgatgctgtgccggtcggtgttgcccagcaccttgaatttcttgctgggcaccttgtactcgtcggtgatcacggcccagcccacagagttggtgccgatgtccaggccgatgctgtacttcttgtcggctgctgggactccgtggataccgaccttccgcttcttctttggggccatcttatcgtcatcgtctttgtaatcaatatcatgatccttgtagtctccgtcgtggtccagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 54 - DNA, 6897 bp, artificial sequence
  Synthetic
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcactgggccaggattctcctcgacgtcaccgcatgttagcagacttcctctgccctctccactgccgaattcctttttcttttttgcctggccggcctttttcgtggccgccggccttttgtcgcctcccagctgagacaggtcgatccgtgtctcgtacaggccggtgatgctctggtggatcagggtggcgtccagcacctctttggtgctggtgtacctcttccggtcgatggtggtgtcaaagtacttgaaggcggcaggggctcccagattggtcagggtaaacaggtggatgatattctcggcctgctctctgatgggcttatcccggtgcttgttgtaggcggacagcactttgtccagattagcgtcggccaggatcactctcttggagaactcgctgatctgctcgatgatctcgtccaggtagtgcttgtgctgttccacaaacagctgtttctgctcattatcctcgggggagcccttcagcttctcatagtggctggccaggtacaggaagttcacatatttggagggcagggccagttcgtttcccttctgcagttcgccggcagaggccagcattctcttccggccgttttccagctcgaacagggagtacttaggcagcttgatgatcaggtcctttttcacttctttgtagcccttggcttccagaaagtcgatgggattcttctcgaagctgcttctttccatgatggtgatccccagcagctctttcacactcttcagtttcttggacttgcccttttccactttggccaccaccagcacagaataggccacggtggggctgtcgaagccgccgtacttcttagggtcccagtccttctttctggcgatcagcttatcgctgttcctcttgggcaggatagactctttgctgaagccgcctgtctgcacctcggtctttttcacgatattcacttggggcatgctcagcactttccgcacggtggcaaaatcccggcccttatcccacacgatctccccggtttcgccgtttgtctcgatcagaggccgcttccggatctcgccgttggccagggtaatctcggtcttgaaaaagttcatgatgttgctgtagaagaagtacttggcggtagccttgccgatttcctgctcgctcttggcgatcatcttccgcacgtcgtacaccttgtagtcgccgtacacgaactcgctttccagcttagggtactttttgatcagggcggttcccacgacggcgttcaggtaggcgtcgtgggcgtggtggtagttgttgatctcgcgcactttgtaaaactggaaatccttccggaaatcggacaccagcttggacttcagggtgatcactttcacttcccggatcagcttgtcattctcgtcgtacttagtgttcatccgggagtccaggatctgtgccacgtgctttgtgatctgccgggtttccaccagctgtctcttgatgaagccggccttatccagttcgctcaggccgcctctctcggccttggtcagattgtcgaactttctctgggtaatcagcttggcgttcaatttcactttggtcagctcgttatacacggtgaagtactcgtacagcaggctgtgcttgggcagcaccttctcgttgggcaggttcttatcgaagttggtcatccgctcgatgaagctctgggcggaagcgcccttgtccaccacttcctcgaagttccagggggtgatggtttcctcgctctttctggtcatccaggcgaatctgctgtttcccctggccagagggcccacgtagtaggggatgcggaaggtcaggatcttctcgatcttttcccggttgtccttcaggaatgggtaaaaatcttcctgccgccgcagaatggcgtgcagctctcccaggtggatctggtgggggatgctgccgttgtcgaaggtccgctgcttccgcagcaggtcctctctgttcagcttcacgagcagttcctcggtgccgtccatcttttccaggatgggcttgatgaacttgtagaactcttcctggctggctccgccgtcaatgtagccggcgtagccgttcttgctctggtcgaagaaaatctctttgtacttctcaggcagctgctgccgcacgagagctttcagcagggtcaggtcctggtggtgctcgtcgtatctcttgatcatagaggcgctcaggggggccttggtgatctcggtgttcactctcaggatgtcgctcagcaggatggcgtcggacaggttcttggcggccagaaacaggtcggcgtactggtcgccgatctgggccagcaggttgtccaggtcgtcgtcgtaggtgtccttgctcagctgcagtttggcatcctcggccaggtcgaagttgctcttgaagttgggggtcaggcccaggctcagggcaatcaggtttccgaacaggccattcttcttctcgccgggcagctgggcgatcagattttccagccgtctgctcttgctcagtctggcagacaggatggccttggcgtccacgccgctggcgttgatggggttttcctcgaacagctggttgtaggtctgcaccagctggatgaacagcttgtccacgtcgctgttgtcggggttcaggtcgccctcgatcaggaagtggccccggaacttgatcatgtgggccagggccagatagatcagccgcaggtcggccttgtcggtgctgtccaccagtttctttctcaggtggtagatggtggggtacttctcgtggtaggccacctcgtccacgatgttgccgaagatggggtgccgctcgtgcttcttatcctcttccaccaggaaggactcttccagtctgtggaagaagctgtcgtccaccttggccatctcgttgctgaagatctcttgcagatagcagatccggttcttccgtctggtgtatcttcttctggcggttctcttcagccgggtggcctcggctgtttcgccgctgtcgaacagcagggctccgatcaggttcttcttgatgctgtgccggtcggtgttgcccagcaccttgaatttcttgctgggcaccttgtactcgtcggtgatcacggcccagcccacagagttggtgccgatgtccaggccgatgctgtacttcttgtcggctgctgggactccgtggataccgaccttccgcttcttctttggggccatcttatcgtcatcgtctttgtaatcaatatcatgatccttgtagtctccgtcgtggtccagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 55 - DNA, 7971 bp, artificial sequence
  Synthetic
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcactgggccaggattctcctcgacgtcaccgcatgttagcagacttcctctgccctctccactgccgaattcctttttcttttttgcctggccggcctttttcgtggccgccggccttttgtcgcctcccagctgagacaggtcgatccgtgtctcgtacaggccggtgatgctctggtggatcagggtggcgtccagcacctctttggtgctggtgtacctcttccggtcgatggtggtgtcaaagtacttgaaggcggcaggggctcccagattggtcagggtaaacaggtggatgatattctcggcctgctctctgatgggcttatcccggtgcttgttgtaggcggacagcactttgtccagattagcgtcggccaggatcactctcttggagaactcgctgatctgctcgatgatctcgtccaggtagtgcttgtgctgttccacaaacagctgtttctgctcattatcctcgggggagcccttcagcttctcatagtggctggccaggtacaggaagttcacatatttggagggcagggccagttcgtttcccttctgcagttcgccggcagaggccagcattctcttccggccgttttccagctcgaacagggagtacttaggcagcttgatgatcaggtcctttttcacttctttgtagcccttggcttccagaaagtcgatgggattcttctcgaagctgcttctttccatgatggtgatccccagcagctctttcacactcttcagtttcttggacttgcccttttccactttggccaccaccagcacagaataggccacggtggggctgtcgaagccgccgtacttcttagggtcccagtccttctttctggcgatcagcttatcgctgttcctcttgggcaggatagactctttgctgaagccgcctgtctgcacctcggtctttttcacgatattcacttggggcatgctcagcactttccgcacggtggcaaaatcccggcccttatcccacacgatctccccggtttcgccgtttgtctcgatcagaggccgcttccggatctcgccgttggccagggtaatctcggtcttgaaaaagttcatgatgttgctgtagaagaagtacttggcggtagccttgccgatttcctgctcgctcttggcgatcatcttccgcacgtcgtacaccttgtagtcgccgtacacgaactcgctttccagcttagggtactttttgatcagggcggttcccacgacggcgttcaggtaggcgtcgtgggcgtggtggtagttgttgatctcgcgcactttgtaaaactggaaatccttccggaaatcggacaccagcttggacttcagggtgatcactttcacttcccggatcagcttgtcattctcgtcgtacttagtgttcatccgggagtccaggatctgtgccacgtgctttgtgatctgccgggtttccaccagctgtctcttgatgaagccggccttatccagttcgctcaggccgcctctctcggccttggtcagattgtcgaactttctctgggtaatcagcttggcgttcagcagctgccgccagtagttcttcatcttcttcacgacctcttcggagggcacgttgtcgctcttgccccggttcttgtcgcttctggtcagcaccttgttgtcgatggagtcgtccttcagaaagctctgaggcacgatatggtccacatcgtagtcggacagccggttgatgtccagttcctggtccacgtacatatcccgcccattctgcaggtagtacaggtacagcttctcgttctgcagctgggtgttttccacggggtgttctttcaggatctggctgcccagctctttgatgccctcttcgatccgcttcattctctcgcggctgttcttctgtcccttctgggtggtctggttctctctggccatttcgatcacgatgttctcgggcttgtgccggcccatcactttcacgagctcgtccaccaccttcactgtctgcaggatgcccttcttaatggcggggctgccggccagattggcaatgtgctcgtgcaggctatcgccctggccggacacctgggctttctggatgtcctctttaaaggtcaggctgtcgtcgtggatcagctgcatgaagtttctgttggcgaagccgtcggacttcaggaaatccaggattgtcttgccggactgcttgtcccggatgccgttgatcagcttccggctcagcctgccccagccggtgtatctccgccgcttcagctgcttcatcactttgtcgtcgaacaggtgggcataggttttcagccgttcctcgatcatctctctgtcctcaaacagtgtcagggtcagcacgatatcttccagaatgtcctcgttttcctcattgtccaggaagtccttgtccttgataattttcagcagatcgtggtatgtgcccagggaggcgttgaaccgatcttccacgccggagatttccacggagtcgaagcactcgattttcttgaagtagtcctctttcagctgcttcacggtcactttccggttggtcttgaacagcaggtccacgatggcctttttctgctcgccgctcaggaaggcgggctttctcattccctcggtcacgtatttcactttggtcagctcgttatacacggtgaagtactcgtacagcaggctgtgcttgggcagcaccttctcgttgggcaggttcttatcgaagttggtcatccgctcgatgaagctctgggcggaagcgcccttgtccaccacttcctcgaagttccagggggtgatggtttcctcgctctttctggtcatccaggcgaatctgctgtttcccctggccagagggcccacgtagtaggggatgcggaaggtcaggatcttctcgatcttttcccggttgtccttcaggaatgggtaaaaatcttcctgccgccgcagaatggcgtgcagctctcccaggtggatctggtgggggatgctgccgttgtcgaaggtccgctgcttccgcagcaggtcctctctgttcagcttcacgagcagttcctcggtgccgtccatcttttccaggatgggcttgatgaacttgtagaactcttcctggctggctccgccgtcaatgtagccggcgtagccgttcttgctctggtcgaagaaaatctctttgtacttctcaggcagctgctgccgcacgagagctttcagcagggtcaggtcctggtggtgctcgtcgtatctcttgatcatagaggcgctcaggggggccttggtgatctcggtgttcactctcaggatgtcgctcagcaggatggcgtcggacaggttcttggcggccagaaacaggtcggcgtactggtcgccgatctgggccagcaggttgtccaggtcgtcgtcgtaggtgtccttgctcagctgcagtttggcatcctcggccaggtcgaagttgctcttgaagttgggggtcaggcccaggctcagggcaatcaggtttccgaacaggccattcttcttctcgccgggcagctgggcgatcagattttccagccgtctgctcttgctcagtctggcagacaggatggccttggcgtccacgccgctggcgttgatggggttttcctcgaacagctggttgtaggtctgcaccagctggatgaacagcttgtccacgtcgctgttgtcggggttcaggtcgccctcgatcaggaagtggccccggaacttgatcatgtgggccagggccagatagatcagccgcaggtcggccttgtcggtgctgtccaccagtttctttctcaggtggtagatggtggggtacttctcgtggtaggccacctcgtccacgatgttgccgaagatggggtgccgctcgtgcttcttatcctcttccaccaggaaggactcttccagtctgtggaagaagctgtcgtccaccttggccatctcgttgctgaagatctcttgcagatagcagatccggttcttccgtctggtgtatcttcttctggcggttctcttcagccgggtggcctcggctgtttcgccgctgtcgaacagcagggctccgatcaggttcttcttgatgctgtgccggtcggtgttgcccagcaccttgaatttcttgctgggcaccttgtactcgtcggtgatcacggcccagcccacagagttggtgccgatgtccaggccgatgctgtacttcttgtcggctgctgggactccgtggataccgaccttccgcttcttctttggggccatcttatcgtcatcgtctttgtaatcaatatcatgatccttgtagtctccgtcgtggtccagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 56 - DNA, 12789 bp, artificial sequence
  Synthetic
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcactgggccaggattctcctcgacgtcaccgcatgttagcagacttcctctgccctctccactgccgaattcctttttcttttttgcctggccggcctttttcgtggccgccggccttttgtcgcctcccagctgagacaggtcgatccgtgtctcgtacaggccggtgatgctctggtggatcagggtggcgtccagcacctctttggtgctggtgtacctcttccggtcgatggtggtgtcaaagtacttgaaggcggcaggggctcccagattggtcagggtaaacaggtggatgatattctcggcctgctctctgatgggcttatcccggtgcttgttgtaggcggacagcactttgtccagattagcgtcggccaggatcactctcttggagaactcgctgatctgctcgatgatctcgtccaggtagtgcttgtgctgttccacaaacagctgtttctgctcattatcctcgggggagcccttcagcttctcatagtggctggccaggtacaggaagttcacatatttggagggcagggccagttcgtttcccttctgcagttcgccggcagaggccagcattctcttccggccgttttccagctcgaacagggagtacttaggcagcttgatgatcaggtcctttttcacttctttgtagcccttggcttccagaaagtcgatgggattcttctcgaagctgcttctttccatgatggtgatccccagcagctctttcacactcttcagtttcttggacttgcccttttccactttggccaccaccagcacagaataggccacggtggggctgtcgaagccgccgtacttcttagggtcccagtccttctttctggcgatcagcttatcgctgttcctcttgggcaggatagactctttgctgaagccgcctgtctgcacctcggtctttttcacgatattcacttggggcatgctcagcactttccgcacggtggcaaaatcccggcccttatcccacacgatctccccggtttcgccgtttgtctcgatcagaggccgcttccggatctcgccgttggccagggtaatctcggtcttgaaaaagttcatgatgttgctgtagaagaagtacttggcggtagccttgccgatttcctgctcgctcttggcgatcatcttccgcacgtcgtacaccttgtagtcgccgtacacgaactcgctttccagcttagggtactttttgatcagggcggttcccacgacggcgttcaggtaggcgtcgtgggcgtggtggtagttgttgatctcgcgcactttgtaaaactggaaatccttccggaaatcggacaccagcttggacttcagggtgatcactttcacttcccggatcagcttgtcattctcgtcgtacttagtgttcatccgggagtccaggatctgtgccacagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtagtcttcagagatggggatgctgttgattgtagccgttgctctttcaatgagggtggattcttcttgagacaaaggcttggccatcggtccaggattctcttcgacatctccggcttgtttcagcagagagaagtttgttgcgccggatccggcatagtcggggacatcatatgggtatgcataatcaggcacgtcgtagggataagcgtaatctggaacatcgtatgggtatttcttcttcttagcctgtccagccttctttgtggcggcaggtcgcttggatcccttgtacagctcatccataccgagagtgatgcctgcggcagtcacaaattccagaaggaccatgtgatctctcttttcgtttgggtccttggaaagctttgattgcgtggagagataatgattgtcaggcaagagtacaggtccatctccgatgggcgtattttgttggtaatgatcagccagttgaacactaccatcttcgacattatgtcggatcttaaagttggcctttatcccatttttctgcttatcagcggtaatatacacattatggctgttaaagttgtactccaacttgtgccccagtatgttaccgtcctccttaaaatcaatacctttcagttcaattcgattaaccagagtgtccccttcaaatttaacctcggctcgggttttatatgtaccatcatccttaaagctgatggtcctttcttgaacataaccttcaggcattgcagacttgaaaaagtcatgctgtttcatgtggtcgggatatcgagaaaagcattgcacgccgtaggtgagggtcgttacgagtgtaggccatgggacgggcagtttgcccgtcgtacagatgaatttcagagtcagcttaccattcgtggcgtccccttcgccttcgcccctgacggagaatttatgtccatttacatctccatcaagctctaccagaatgggcactactccagtgaagagttcttcacctttactcacgctacctcctcctccgcttcctcctcctccgcttccacctcctccttccagggccttgtactcgaacatgactttcacgagttcgcacagttcctcgctgttccggtcggtcatcagtttctttttcttcagattcttcaggtgcacgatcttctctgattccagggtctggatttcgatcttcttgtcagcgccgatcttgaaggtggccacgaagccgtattctttcagaatgtccacgatggacttcatgatggcgttcttcagcttccggtcgtaggacagcagcttccgcaggttttccagcacttccagcaggctaatctcggcgtgggggatgtagttgaagtgggcaatgtagttccggatgtacaggtcctttttttcctgcttcagtttcttcactttcttgtcggagtagatgctccgcttttccacattgtccttgtacagttctttgtagaagttgatatacttttccacgatctggccgcttttgtacttcacattcttggagttgtcgaaattgaaaatttcctcgatgtagtggttctcgggaaactcgcccttcagccggaatctcaggtcccgctcccagatgctggtgtagcccacgagccggtgcaggatcttcagcagcaggccctgcagcaggttcagctcattgaattccaccttgttcttcaggtgggtgtacttctggatgttgccgatggccttctcatactctttgtagtcctcgtcgttgaacttttcgtccttcttgggtctggcgtacttccggtgcaggttctgctgcatggtgtagttcttttcaatctcattcttcttgttgctgtactctttcagttctttcaggctgatcttatacttggccttatcggcgatcttttccagcagattcagcatgccgtatttcttgatattgtagaaggcccggtgcttgatgatgttctcgccgtcgaaatagatcttgttggtgtcgaactttttcagctctttccggtccttgattttgttttcgttgaagtccaggaacttgccgatctcgttggcttccagctcgaagtcctcggtcactctgttgttgtccaggttcagcaggttgatcagttccaactcgtcgctgaaggtttcttctttgttggcggactggtacttttccaggctgcccttcaggttggtcagctctttgtggttcagcagcttcaggatcaggtaaaacatgttcagattctcggtgtacttcagaatcttccccagcttgatctcgcgcacgaactcattgatctcgtgagggatttctttgttccgattgtgcttctcatagttcttcaggatcttgtcgtacttctctttgttatcctttttgatcttgatcttggagaagatgtcgttgttgtcattgttgttgttgctctcgatatacttcagattgttcttgttcaggtagtcgatgaagcccttcaggaaaatctgctgaataaagtcgatgtaggtattcttttcctctttgtcctggttgttgatcatctctctgctctggatgatggccaggtattccacgggcacggttttctcgatgttctcgaacttctgatacttgtagtggccggttttctggttccgctgcttgttaatcttgatcacttcattggtgatcttaaagaacaccttggagtttttcacgaacttgttcaggaactcgccgtagtagatattcttcagcaggtagatctgggcgtccttctcttctttgtccttgggcacgctccaaaaaaacttcagggtattccgcaggtcctcaatcttgttgtacagcttggtgaagctgggcacgaaggggatgtttttgttcacgaagttgaacttggtattcttcaggtacttgatgatcacatccttctcgtagtagttgaacacgttggcgctgttcagctgcttgaagattttcagcttcagcttcttttcgttgatttcgttctgaaacatcttcttggagatctcgctgggggcgatattcttgaaggcgaagatgtccttgccttccagttccaggttgaagtgcacgatgccgtgtctgatgctgctgatggcctcgtcgatgttggcgaagaagtcctcgatctcgttcttgttgtccatgttgaagtcgtagctgtagaacatcttcagattttctttcacttcgttctgcttgttctcattgtagatcttgtccacctcgccggacacgtatttctcttcgcccttgttgttcttcacggtcttgccccgcatccggccggtgataccgttctcgttctcggtttccaggatgttcctcaggctgaagtaggccacgctggacacgccgatgatgtttctcaggaaggcctcgttctgccggttccgggcgataaagtcggaggtggcgatctcgcccacttgcagatagtagttgtacttgccgcagttccgcacgtaggtgtccagcttgttcagcagtttgttttcgatcagctttttcagattctggtactcgaagatccgcttgatcttatcgttgctgatgttgctcagccgcttgtacacgtagtttttcagcagctgggacatctcgatttccacgaagtggcagaaggcgtacttaatattcttgtcgttcagttcctctttgtccaggtagtacttgtagaacacctggcttttcttcagctcagacatgtcggggatcttctcaatcagctctttgatgttgttcacgttctggatctcttcgtagataatcttggcgaagttctctttgtcgttcttccggccgatgatcttgtgatagtactcgcggatcttgtacttctcgtgcttcttgctgttctcgatcaggaaaaacagtttctcgatatcctctttcttatacagcttgtcgaaggcttcctgcacgttgttgatgtagtcgttgcgcttggcgctctctctgtagtagtcgtagatgatgttccgcttgctcttgccgcccactttttccacgttgttctcgttgatcttctggtagttggccttgttctcttcgaagctgtacttcaggctgttgatcttgttcagcttggcttccacgtccttccgaaagatttccagttcctcagagttcacgtcctcgttcagcaggatcttcttcagcacggagaagctgttcttgtttttcaggtcgtactcgctgatgtcctcttcgctatagttcttgtcctgcacggcgttcttttctttccggttcttcagatacagcacgctgtccttcaggtgcagcaccttgttgctaaagaacttcttcaggttctctcttctgatccggttctcttcctcggaggcgttgtcggggttcttgatgtagatgtccagccggatgctcagcagctcgctcagtctctcgctggtccggttttcctcgctggtggacttcacgagcttgccctcttcgatgtacttcttgtggctgatgccgtcgaccttggtcactttcatggatcgtgctttgtgatctgccgggtttccaccagctgtctcttgatgaagccggccttatccagttcgctcaggccgcctctctcggccttggtcagattgtcgaactttctctgggtaatcagcttggcgttcagcagctgccgccagtagttcttcatcttcttcacgacctcttcggagggcacgttgtcgctcttgccccggttcttgtcgcttctggtcagcaccttgttgtcgatggagtcgtccttcagaaagctctgaggcacgatatggtccacatcgtagtcggacagccggttgatgtccagttcctggtccacgtacatatcccgcccattctgcaggtagtacaggtacagcttctcgttctgcagctgggtgttttccacggggtgttctttcaggatctggctgcccagctctttgatgccctcttcgatccgcttcattctctcgcggctgttcttctgtcccttctgggtggtctggttctctctggccatttcgatcacgatgttctcgggcttgtgccggcccatcactttcacgagctcgtccaccaccttcactgtctgcaggatgcccttcttaatggcggggctgccggccagattggcaatgtgctcgtgcaggctatcgccctggccggacacctgggctttctggatgtcctctttaaaggtcaggctgtcgtcgtggatcagctgcatgaagtttctgttggcgaagccgtcggacttcaggaaatccaggattgtcttgccggactgcttgtcccggatgccgttgatcagcttccggctcagcctgccccagccggtgtatctccgccgcttcagctgcttcatcactttgtcgtcgaacaggtgggcataggttttcagccgttcctcgatcatctctctgtcctcaaacagtgtcagggtcagcacgatatcttccagaatgtcctcgttttcctcattgtccaggaagtccttgtccttgataattttcagcagatcgtggtatgtgcccagggaggcgttgaaccgatcttccacgccggagatttccacggagtcgaagcactcgattttcttgaagtagtcctctttcagctgcttcacggtcactttccggttggtcttgaacagcaggtccacgatggcctttttctgctcgccgctcaggaaggcgggctttctcattccctcggtcacgtatttcactttggtcagctcgttatacacggtgaagtactcgtacagcaggctgtgcttgggcagcaccttctcgttgggcaggttcttatcgaagttggtcatccgctcgatgaagctctgggcggaagcgcccttgtccaccacttcctcgaagttccagggggtgatggtttcctcgctctttctggtcatccaggcgaatctgctgtttcccctggccagagggcccacgtagtaggggatgcggaaggtcaggatcttctcgatcttttcccggttgtccttcaggaatgggtaaaaatcttcctgccgccgcagaatggcgtgcagctctcccaggtggatctggtgggggatgctgccgttgtcgaaggtccgctgcttccgcagcaggtcctctctgttcagcttcacgagcagttcctcggtgccgtccatcttttccaggatgggcttgatgaacttgtagaactcttcctggctggctccgccgtcaatgtagccggcgtagccgttcttgctctggtcgaagaaaatctctttgtacttctcaggcagctgctgccgcacgagagctttcagcagggtcaggtcctggtggtgctcgtcgtatctcttgatcatagaggcgctcaggggggccttggtgatctcggtgttcactctcaggatgtcgctcagcaggatggcgtcggacaggttcttggcggccagaaacaggtcggcgtactggtcgccgatctgggccagcaggttgtccaggtcgtcgtcgtaggtgtccttgctcagctgcagtttggcatcctcggccaggtcgaagttgctcttgaagttgggggtcaggcccaggctcagggcaatcaggtttccgaacaggccattcttcttctcgccgggcagctgggcgatcagattttccagccgtctgctcttgctcagtctggcagacaggatggccttggcgtccacgccgctggcgttgatggggttttcctcgaacagctggttgtaggtctgcaccagctggatgaacagcttgtccacgtcgctgttgtcggggttcaggtcgccctcgatcaggaagtggccccggaacttgatcatgtgggccagggccagatagatcagccgcaggtcggccttgtcggtgctgtccaccagtttctttctcaggtggtagatggtggggtacttctcgtggtaggccacctcgtccacgatgttgccgaagatggggtgccgctcgtgcttcttatcctcttccaccaggaaggactcttccagtctgtggaagaagctgtcgtccaccttggccatctcgttgctgaagatctcttgcagatagcagatccggttcttccgtctggtgtatcttcttctggcggttctcttcagccgggtggcctcggctgtttcgccgctgtcgaacagcagggctccgatcaggttcttcttgatgctgtgccggtcggtgttgcccagcaccttgaatttcttgctgggcaccttgtactcgtcggtgatcacggcccagcccacagagttggtgccgatgtccaggccgatgctgtacttcttgtcggctgctgggactccgtggataccgaccttccgcttcttctttggggccatcttatcgtcatcgtctttgtaatcaatatcatgatccttgtagtctccgtcgtggtccagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 57 - DNA, 3633 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttcaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 58 - DNA, 3613 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacataggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 59 - DNA, 3603 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 60 - DNA, 3593 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaaaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 61 - DNA, 3583 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 62 - DNA, 3573 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgataaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 63 - DNA, 3563 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccaaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 64 - DNA, 3553 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 65 - DNA, 3543 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 66 - DNA, 3533 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 67 - DNA, 3523 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 68 - DNA, 3513 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgataggaggtaaataatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 69 - DNA, 3626 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagcttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 70 - DNA, 3616 bp, artificial sequence
  Synthetic
caccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgaccta

SEQ ID NO: 71 - DNA, 3606 bp, artificial sequence
  Synthetic
tgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctaggaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctgg

SEQ ID NO: 72 - DNA, 3596 bp, artificial sequence
  Synthetic
cgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggag

SEQ ID NO: 73 - DNA, 3586 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 74 - DNA, 3576 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 75 - DNA, 3566 bp, artificial sequence
  Synthetic
attgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagtgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatc

SEQ ID NO: 76 - DNA, 3556 bp, artificial sequence
  Synthetic
caggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcaca

SEQ ID NO: 77 - DNA, 3546 bp, artificial sequence
  Synthetic
cccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttat

SEQ ID NO: 78 - DNA, 3536 bp, artificial sequence
  Synthetic
cccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctaggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttat

SEQ ID NO: 79 - DNA, 3526 bp, artificial sequence
  Synthetic
cccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagtgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttat

SEQ ID NO: 80 - DNA, 3516 bp, artificial sequence
  Synthetic
cccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagtaattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttat

SEQ ID NO: 81 - DNA, 3506 bp, artificial sequence
  Synthetic
cccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttat

SEQ ID NO: 82 - DNA, 3496 bp, artificial sequence
  Synthetic
cccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttat

SEQ ID NO: 83 - DNA, 3486 bp, artificial sequence
  Synthetic
cccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttat

SEQ ID NO: 84 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgtacagcgcggctgaaatcatcattaaagcgagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 85 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactacagcgcggctgaaatcatcattaaagcgaggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 86 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacacagcgcggctgaaatcatcattaaagcgagtgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 87 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataaccagcgcggctgaaatcatcattaaagcgagtggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 88 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagcgcggctgaaatcatcattaaagcgagtgggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 89 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgcgcggctgaaatcatcattaaagcgagtggcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 90 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataaccgcggctgaaatcatcattaaagcgagtggcagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 91 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgcggctgaaatcatcattaaagcgagtggcaagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 92 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataaccggctgaaatcatcattaaagcgagtggcaacgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 93 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacggctgaaatcatcattaaagcgagtggcaacagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 94 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgctgaaatcatcattaaagcgagtggcaacatgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 95 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacctgaaatcatcattaaagcgagtggcaacatggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 96 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactgaaatcatcattaaagcgagtggcaacatgggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 97 - DNA, 8445 bp, artificial sequence
  Synthetic
attcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgaaatcatcattaaagcgagtggcaacatggagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgcc

SEQ ID NO: 98 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacaaatcatcattaaagcgagtggcaacatggaagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 99 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacaatcatcattaaagcgagtggcaacatggaaagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 100 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactcatcagcgcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 101 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtagtcggcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 102 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagccgccctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 103 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcgggactaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 104 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgattagatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 105 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatctagtttaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 106 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcaaattagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 107 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaatcgcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 108 - DNA, 8421 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 109 - DNA, 8427 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 110 - DNA, 8433 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 111 - DNA, 8439 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 112 - DNA, 8451 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcgagtggcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 113 - DNA, 8457 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcgagtggcaacatggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 114 - DNA, 8463 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcgagtggcaacatggaaatcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 115 - DNA, 8469 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcgagtggcaacatggaaatcgctgatgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 116 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagcggtgcacgggtgaactgatcgcgcagcgggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 117 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgcgccactggtgtgggccataattcaattcgcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 118 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacaaaagtttgtgttttttaaatagtacataatggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 119 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataaccgagtttgtcagaaagcagaccaaacagcggtgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 120 - DNA, 5335 bp, artificial sequence
  Synthetic
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctaacaggttggatgataagtccccggtcttcgtatgccgtcttctgcttggcgcgccctcgagcaattgaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgactctagaatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacctgcagggcgcgccaagcagaagacggcatacgaagaccggggacttatcatccaacctgttaggatccagtgagcgcaacgcaattaatgtgagttagctcactcattaggcaccccaggctttacactttatgcttccggctcgtatgttgtgtggaattgtgagcggatacatatggaaaaaaaggaatttcgtgttttgataaaatactgttttctgaagggaaaaaatacagtggaagcaaaaacttggcttgataatgagtttccggactctgccccagggaaatcaacaataattgattggtatgcaaaattcaagcgtggtgaaatgagcacggaggacggtgaacgcagtggacgcccgaaagaggtggttaccgacgaaaacatcaaaaaaatccacaaaatgattttgaatgaccgtaaaatgaagttgatcgagatagcagaggccttaaagatatcaaaggaacgtgttggtcatatcattcatcaatatttggatatgcggaagctctgtgcgaaatgggtgccgcgcgagctcacatttgaccaaaaacaacgacgtgttgatgattctaagcggtgtttgcagctgttaactcgtaatacacccgagtttttccgtcgatatgtgacaatggatgaaacatggctccatcactacactcctgagtccaatcgacagtcggctgagtggacagcgaccggtgaaccgtctccgaagcgtggaaagactcaaaagtccgctggcaaagtaatggcctctgttttttgggatgcgcatggaataatttttatcgattatcttgagaagggaaaaaccatcaacagtgactattatatggcgttattggagcgtttgaaggtcgaaatcgcggcaaaacggccccacatgaagaagaaaaaagtgttgttccaccaagacaacgcaccgtgccacaagtcattgagaacgatggcaaaaattcatgaattgggcttcgaattgcttccccacccgccgtattctccagatctggcccccagcgactttttcttgttctcagacctcaaaaggatgctcgcagggaaaaaatttggctgcaatgaagaggtgatcgccgaaactgaggcctattttgaggcaaaaccgaaggagtactaccaaaatggtatcaaaaaattggaaggtcgttataatcgttgtatcgctcttgaagggaactatgttgaataagcggccgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 121 - DNA, 3630 bp, artificial sequence
  Synthetic
aacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttggaacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaa

SEQ ID NO: 122 - DNA, 3630 bp, artificial sequence
  Synthetic
gccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttgatacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgctccaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgac

SEQ ID NO: 123 - DNA, 3630 bp, artificial sequence
  Synthetic
gccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttggaacaaccataaaatgataattacacccataaattgataattatcacacccataaattgatattgcctcttcatggtctaaacttcagtaagtttacgacattttcatgaagaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgctccaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgac

SEQ ID NO: 124 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgcctggcttggcgatgctcgcctgatcgacaagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 125 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgtcagagtggcgtatccgatgaatcaccacaggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 126 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactcgatccgtgggtgtttatgttctcagcaggagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 127 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgcattactaagctggcgcgtgaagctgtagaagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 128 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgagaatattgtggcaaaagcgcataaggtgctgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 129 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgcagaagtgcacggcgtgtgcggcggcgagcagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 130 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacttacttacggcgttgcgcattctcattgcaccgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 131 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacggggcgtaaaaagaaggggcgctgattaacgcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 132 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactcttgctgagattgataaggtaattaaccttagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 133 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgactgcaagtgagtcggcttttttgttgctaagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 134 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgcaaacaactgagaaatttttaattcgctctggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 135 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacattgaacgcgcgaagcacgccgccggacaggtgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 136 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactggcccacgttgtggatcacccgttaaacaaagtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 137 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactgaagataggtctggtcggcgaagaaaccgccgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 138 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagcctgtaatctctgcttaaaagcacagaatcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 139 - DNA, 8445 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataactgagattttcactcgtcagtgtgaacacaattgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 140 - DNA, 690 bp, artificial sequence
  Synthetic
atgacaagcttacctacgccctcagcaattacgacttcggcgttagagtatgcattccatactcccgctcgcaatctaacgaaatctcgcggaaaaaatattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaa

SEQ ID NO: 141 - protein, 229 aa, Vibrio cholerae HE-45
MTSLPTPSAITTSALEYAFHTPARNLTKSRGKNIHRYVSVKMSKRITVESTLECDACYHFDFEPSIVRFCAQPIRFLYYLNGQSHSYVPDFLVQFDTNEFVLYEVKSAYAKNKPDFDVEWEAKVKAATELGLELELVEESDIRDTVVLNNLKRMHRYASKDELNNVHNSLLKIIKYNGAQSARCLGEQLGLKGRTVLPILCDLLSRCLLDTRLDKPLSLESRFELASYG

SEQ ID NO: 142 - DNA, 1812 bp, artificial sequence
  Synthetic
atggctaagaaagggttctcgagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaattccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatgggatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaagacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctga

SEQ ID NO: 143 - protein, 603 aa, Vibrio cholerae HE-45
MAKKGFSSFHRKAVSSQDTLESIELVSSANCLESVTYQDISAFPETIAVEINFRLSILRFLARKCETIVAKSIEPHRVELQQNYSRKIPSAITIYRWWLAFRKSDYNPISLAPNIKDRGNRETKVSTVVDSIMEQAVERVISGRKVNVSSAYKRVRRKVRQYNLTHGTKYTYPKYESVRKRVKKKTPFELLAAGKGERVAKREFRRMGKKILTSSVLERVEIDHTVVDLFAVHEEYRIPLGRPWLTQLVDCYSKAVIGFYLGFEPPSYVSVSLALKNAIQRKDDLISSYESIENEWLCYGIPDLLVTDNGKEFLSKAFDQACESLLINVHQNKVETPDNKPHVERNYGTINTSLLDDLPGKSFSQYLQREGYDSVGEATLTLNEIREIYLIWLVDIYHKKPNQRGTNCPNVAWKKGCQEWEPEEFSGSKDELDFKFAIVDYKQLTKVGITVYKELSYSNDRLAEYRGKKGNHKVQFKYNPECMAVIWVLDEDMNEYFTVNAIDYEYASRVSLWQHKYNMKYQAELNSAEYDEDKEIDAEIKIEEIADRSIVKTNKIRARRRGARHQENSARAKSISNANPASIQKHEDEIVSADNDDWDIDYV

SEQ ID NO: 144 - DNA, 993 bp, artificial sequence
  Synthetic
atgagtgaaacgcgtgaggctcgtatatcaagagctaaaagggcatttgtatccacaccgagcgttaggaaaatcttgagttacatggatagatgtagagacctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaagactatttgagacattcaaccccgagagtgagtaaaccaggtagaaataaaaactttttcgaataa

SEQ ID NO: 145 - protein, 330 aa, Vibrio cholerae HE-45
MSETREARISRAKRAFVSTPSVRKILSYMDRCRDLSDLESEPTCMMVYGASGVGKTTVIKKYLNQNRRESEAGGDIIPVLHIELPDNAKPVDAARELLVEMGDPLALYETDLARLTKRLTELIPAVGVKLIIIDEFQHLVEERSNRVLTQVGNWLKMILNKTKCPIVIFGMPYSKVVLQANSQLHGRFSIQVELRPFSYQGGRGVFKTFLEYLDKALPFEKQAGLANESLQKKLYAFSQGNMRSLRNLIYQASIEAIDNQHETITEEDFVFASKLTSGDKPNSWKNPFEEGVEVTEDMLRPPPKDIGWEDYLRHSTPRVSKPGRNKNFFE

SEQ ID NO: 146 - DNA, 1185 bp, artificial sequence
  Synthetic
atgtttttgcaaagacctaaaccttacagcgatgaaagcttagaaagcttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaagcttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgaattcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgaattccaaagcgatgagtttaaccgttcgttttatgtgtcgaggtggtaa

SEQ ID NO: 147 - protein, 394 aa, Vibrio cholerae HE-45
MFLQRPKPYSDESLESFFIRVANKNGYGDVHRFLEATKRFLQDIDHNGYQTFPTDITRINPYSAKNSSSARTASFLKLAQLTFNEPPELLGLAINRTNMKYSPSTSAVVRGAEVFPRSLLRTHSIPCCPLCLRENGYASYLWHFQGYEYCHSHNVPLITTCSCGKEFDYRVSGLKGICCKCKEPITLTSRENGHEAACTVSNWLAGHESKPLPNLPKSYRWGLVHWWMGIKDSEFDHFSFVQFFSNWPRSFHSIIEDEVEFNLEHAVVSTSELRLKDLLGRLFFGSIRLPERNLQHNIILGELLCYLENRLWQDKGLIANLKMNALEATVMLNCSLDQIASMVEQRILKPNRKSKPNSPLDVTDYLFHFGDIFCLWLAEFQSDEFNRSFYVSRW

SEQ ID NO: 148 - DNA, 1923 bp, artificial sequence
  Synthetic
atgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaactacagacaaagccataacccaaaattcccggatatacgttctgaaggcgtgattcgaacccaagccctaggtgaattaccgagtttcctactctcgtcttcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttaacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggatcccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcgaggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatga

SEQ ID NO: 149 - protein, 640 aa, Vibrio cholerae HE-45
MQTLKELIASNPDDLTTELKRAFRPLTPHIAIDGNELDALTILVNLTDKTDDQKDLLDRAKCKQKLRDEKWWASCINCVNYRQSHNPKFPDIRSEGVIRTQALGELPSFLLSSSKIPPYHWSYSHDSKYVNKSAFLTNEFCWDGEISCLGELLKDADHPLWNTLKKLGCSQKTCKAMAKQLADITLTTINVTLAPNYLTQISLPDSDTSYISLSPVASLSMQSHFHQRLQDENRHSAITRFSRTTNMGVTAMTCGGAFRMLKSGAKFSSPPHHRLNSKRSWLTSEHVQSLKQYQRLNKSLIPENSRIALRRKYKIELQNMVRSWFAMQDHTLDSNILIQHLNHDLSYLGATKRFAYDPAMTKLFTELLKRELSNSINNGEQHTNGSFLVLPNIRVCGATALSSPVTVGIPSLTAFFGFVHAFERNINRTTSSFRVESFAICVHQLHVEKRGLTAEFVEKGDGTISAPATRDDWQCDVVFSLILNTNFAQHIDQDTLVTSLPKRLARGSAKIAIDDFKHINSFSTLETAIESLPIEAGRWLSLYAQSNNNLSDLLAAMTEDHQLMASCVGYHLLEEPKDKPNSLRGYKHAIAECIIGLINSITFSSETDPNTIFWSLKNYQNYLVVQPRSINDETTDKSSL

SEQ ID NO: 150 - DNA, 1059 bp, artificial sequence
  Synthetic
atgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatatggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaatatttgcaacggtaaatggctgtggaaaaatacccgtaaagcttattgctggaacattgtacttacaccttggccatggaacggggaaaaggttggatttgaagatatccgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactga

SEQ ID NO: 151 - protein, 352 aa, Vibrio cholerae HE-45
MKLPTNLAYERSIDPSDVCFFVVWPDDRKTPLTYNSRTLLGQMEAASLAYDVSGQPIKSATAEALAQGNPHQVDFCHVPYGASHIECSFSVSFSSELRQPYKCNSSKVKQTLVQLVELYETKIGWTELATRYLMNICNGKWLWKNTRKAYCWNIVLTPWPWNGEKVGFEDIRTNYTSRQDFKNNKNWSAIVEMIKTAFSSTDGLAIFEVRATLHLPTNAMVRPSQVFTEKESGSKSKSKTQNSRVFQSTTIDGERSPILGAFKTGAAIATIDDWYPEATEPLRVGRFGVHREDVTCYRHPSTGKDFFSILQQAEHYIEVLSANKTPAQETINDMHFLMANLIKGGMFQHKGD

SEQ ID NO: 152 - DNA, 600 bp, artificial sequence
  Synthetic
gtgaaatggtattataagacaatcacctttctgccagagttgtgcaacaacgagtcactggctgcaaagtgtcttcgcgttctgcatggatttaactatcagtatgagacacgaaatattggcgtttcatttccgctttggtgtgatgcaacggttggaaaaaagatttcatttgtcagcaagaacaagatagaactcgacttactacttaaacaacactatttcgtccaaatggaacaacttcaatattttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctga

SEQ ID NO: 153 - protein, 199 aa, Vibrio cholerae HE-45
MKWYYKTITFLPELCNNESLAAKCLRVLHGFNYQYETRNIGVSFPLWCDATVGKKISFVSKNKIELDLLLKQHYFVQMEQLQYFHISNTVLVPEDCTYVSFRRCQSIDKLTAAGLARKIRRLEKRALSRGEQFDPSSFAQKEHTAIAHYHSLGESSKQTNRNFRLNIRMLSEQPREGNSIFSSYGLSNSENSFQPVPLI

SEQ ID NO: 154 - DNA, 28 bp, artificial sequence
  Synthetic
gtgaactgccgagtaggtagctgataac

SEQ ID NO: 155 - DNA, 32 bp, artificial sequence
  Synthetic
gttgtctgacacttgtcacaaaccgctaggag

SEQ ID NO: 156 - RNA, 60 nt, artificial sequence
  Synthetic
cugauaacguugucugacacuugucacaaaccgcuaggaggugaacugccgaguagguag

SEQ ID NO: 157 - DNA, 28 bp, artificial sequence
  Synthetic
gtgaactgccgagtaggtagctgataac

SEQ ID NO: 158 - DNA, 32 bp, artificial sequence
  Synthetic
tgggaggattcataaagcattgtttgttggct

SEQ ID NO: 159 - RNA, 60 nt, artificial sequence
  Synthetic
cugauaacugggaggauucauaaagcauuguuuguuggcugugaacugccgaguagguag

SEQ ID NO: 160 - DNA, 28 bp, artificial sequence
  Synthetic
gtgaactgccgagtaggtagctgataac

SEQ ID NO: 161 - DNA, 32 bp, artificial sequence
  Synthetic
gtcatcttcggctactttttctctgtcacaga

SEQ ID NO: 162 - RNA, 60 nt, artificial sequence
  Synthetic
cugauaacgucaucuucggcuacuuuuucucugucacagagugaacugccgaguagguag

SEQ ID NO: 163 - DNA, 28 bp, artificial sequence
  Synthetic
gtgaactgccgagtaggtagctgataac

SEQ ID NO: 164 - DNA, 32 bp, artificial sequence
  Synthetic
tatcccattacggtcaatccgccgtttgttcc

SEQ ID NO: 165 - RNA, 60 nt, artificial sequence
  Synthetic
cugauaacuaucccauuacggucaauccgccguuuguuccgugaacugccgaguagguag

SEQ ID NO: 166 - DNA, 28 bp, artificial sequence
  Synthetic
gtgaactgccgagtaggtagctgataac

SEQ ID NO: 167 - DNA, 32 bp, artificial sequence
  Synthetic
agtacagcgcggctgaaatcatcattaaagcg

SEQ ID NO: 168 - RNA, 60 nt, artificial sequence
  Synthetic
cugauaacaguacagcgcggcugaaaucaucauuaaagcggugaacugccgaguagguag

SEQ ID NO: 169 - DNA, 28 bp, artificial sequence
  Synthetic
gtgaactgccgagtaggtagctgataac

SEQ ID NO: 170 - DNA, 32 bp, artificial sequence
  Synthetic
agcggtgcacgggtgaactgatcgcgcagcgg

SEQ ID NO: 171 - RNA, 60 nt, artificial sequence
  Synthetic
cugauaacagcggugcacgggugaacugaucgcgcagcgggugaacugccgaguagguag

SEQ ID NO: 172 - DNA, 28 bp, artificial sequence
  Synthetic
gtgaactgccgagtaggtagctgataac

SEQ ID NO: 173 - DNA, 32 bp, artificial sequence
  Synthetic
gcgccactggtgtgggccataattcaattcgc

SEQ ID NO: 174 - RNA, 60 nt, artificial sequence
  Synthetic
cugauaacgcgccacuggugugggccauaauucaauucgcgugaacugccgaguagguag

SEQ ID NO: 175 - DNA, 28 bp, artificial sequence
  Synthetic
gtgaactgccgagtaggtagctgataac

SEQ ID NO: 176 - DNA, 32 bp, artificial sequence
  Synthetic
aaaagtttgtgttttttaaatagtacataatg

SEQ ID NO: 177 - RNA, 60 nt, artificial sequence
  Synthetic
cugauaacaaaaguuuguguuuuuuaaauaguacauaauggugaacugccgaguagguag

SEQ ID NO: 178 - DNA, 28 bp, artificial sequence
  Synthetic
gtgaactgccgagtaggtagctgataac

SEQ ID NO: 179 - DNA, 32 bp, artificial sequence
  Synthetic
cgagtttgtcagaaagcagaccaaacagcggt

SEQ ID NO: 180 - RNA, 60 nt, artificial sequence
  Synthetic
cugauaaccgaguuugucagaaagcagaccaaacagcggugugaacugccgaguagguag

SEQ ID NO: 181 - DNA, 28 bp, artificial sequence
  Synthetic
gtgaactgccgagtaggtagctgataac

SEQ ID NO: 182 - DNA, 32 bp, artificial sequence
  Synthetic
gcctggcttggcgatgctcgcctgatcgacaa

SEQ ID NO: 183 - RNA, 60 nt, artificial sequence
  Synthetic
cugauaacgccuggcuuggcgaugcucgccugaucgacaagugaacugccgaguagguag

SEQ ID NO: 184 - DNA, 28 bp, artificial sequence
  Synthetic
gtgaactgccgagtaggtagctgataac

SEQ ID NO: 185 - DNA, 32 bp, artificial sequence
  Synthetic
gtcagagtggcgtatccgatgaatcaccacag

SEQ ID NO: 186 - RNA, 60 nt, artificial sequence
  Synthetic
cugauaacgucagaguggcguauccgaugaaucaccacaggugaacugccgaguagguag

SEQ ID NO: 187 - DNA, 28 bp, artificial sequence
  Synthetic
gtgaactgccgagtaggtagctgataac

SEQ ID NO: 188 - DNA, 32 bp, artificial sequence
  Synthetic
tcgatccgtgggtgtttatgttctcagcagga

SEQ ID NO: 189 - RNA, 60 nt, artificial sequence
  Synthetic
cugauaacucgauccguggguguuuauguucucagcaggagugaacugccgaguagguag

SEQ ID NO: 190 - DNA, 28 bp, artificial sequence
  Synthetic
gtgaactgccgagtaggtagctgataac

SEQ ID NO: 191 - DNA, 32 bp, artificial sequence
  Synthetic
gcattactaagctggcgcgtgaagctgtagaa

SEQ ID NO: 192 - RNA, 60 nt, artificial sequence
  Synthetic
cugauaacgcauuacuaagcuggcgcgugaagcuguagaagugaacugccgaguagguag

SEQ ID NO: 193 - DNA, 28 bp, artificial sequence
  Synthetic
gtgaactgccgagtaggtagctgataac

SEQ ID NO: 194 - DNA, 32 bp, artificial sequence
  Synthetic
gagaatattgtggcaaaagcgcataaggtgct

SEQ ID NO: 195 - RNA, 60 nt, artificial sequence
  Synthetic
cugauaacgagaauauuguggcaaaagcgcauaaggugcugugaacugccgaguagguag

SEQ ID NO: 196 - DNA, 28 bp, artificial sequence
  Synthetic
gtgaactgccgagtaggtagctgataac

SEQ ID NO: 197 - DNA, 32 bp, artificial sequence
  Synthetic
gcagaagtgcacggcgtgtgcggcggcgagca

SEQ ID NO: 198 - RNA, 60 nt, artificial sequence
  Synthetic
cugauaacgcagaagugcacggcgugugcggcggcgagcagugaacugccgaguagguag

SEQ ID NO: 199 - DNA, 28 bp, artificial sequence
  Synthetic
gtgaactgccgagtaggtagctgataac

SEQ ID NO: 200 - DNA, 32 bp, artificial sequence
  Synthetic
ttacttacggcgttgcgcattctcattgcacc

SEQ ID NO: 201 - RNA, 60 nt, artificial sequence
  Synthetic
cugauaacuuacuuacggcguugcgcauucucauugcaccgugaacugccgaguagguag

SEQ ID NO: 202 - DNA, 28 bp, artificial sequence
  Synthetic
gtgaactgccgagtaggtagctgataac

SEQ ID NO: 203 - DNA, 32 bp, artificial sequence
  Synthetic
ggggcgtaaaaagaaggggcgctgattaacgc

SEQ ID NO: 204 - RNA, 60 nt, artificial sequence
  Synthetic
cugauaacggggcguaaaaagaaggggcgcugauuaacgcgugaacugccgaguagguag

SEQ ID NO: 205 - DNA, 28 bp, artificial sequence
  Synthetic
gtgaactgccgagtaggtagctgataac

SEQ ID NO: 206 - DNA, 32 bp, artificial sequence
  Synthetic
tcttgctgagattgataaggtaattaacctta

SEQ ID NO: 207 - RNA, 60 nt, artificial sequence
  Synthetic
cugauaacucuugcugagauugauaagguaauuaaccuuagugaacugccgaguagguag

SEQ ID NO: 208 - DNA, 28 bp, artificial sequence
  Synthetic
gtgaactgccgagtaggtagctgataac

SEQ ID NO: 209 - DNA, 32 bp, artificial sequence
  Synthetic
gactgcaagtgagtcggcttttttgttgctaa

SEQ ID NO: 210 - RNA, 60 nt, artificial sequence
  Synthetic
cugauaacgacugcaagugagucggcuuuuuuguugcuaagugaacugccgaguagguag

SEQ ID NO: 211 - DNA, 28 bp, artificial sequence
  Synthetic
gtgaactgccgagtaggtagctgataac

SEQ ID NO: 212 - DNA, 32 bp, artificial sequence
  Synthetic
gcaaacaactgagaaatttttaattcgctctg

SEQ ID NO: 213 - RNA, 60 nt, artificial sequence
  Synthetic
cugauaacgcaaacaacugagaaauuuuuaauucgcucuggugaacugccgaguagguag

SEQ ID NO: 214 - DNA, 28 bp, artificial sequence
  Synthetic
gtgaactgccgagtaggtagctgataac

SEQ ID NO: 215 - DNA, 32 bp, artificial sequence
  Synthetic
attgaacgcgcgaagcacgccgccggacaggt

SEQ ID NO: 216 - RNA, 60 nt, artificial sequence
  Synthetic
cugauaacauugaacgcgcgaagcacgccgccggacaggugugaacugccgaguagguag

SEQ ID NO: 217 - DNA, 28 bp, artificial sequence
  Synthetic
gtgaactgccgagtaggtagctgataac

SEQ ID NO: 218 - DNA, 32 bp, artificial sequence
  Synthetic
tggcccacgttgtggatcacccgttaaacaaa

SEQ ID NO: 219 - RNA, 60 nt, artificial sequence
  Synthetic
cugauaacuggcccacguuguggaucacccguuaaacaaagugaacugccgaguagguag

SEQ ID NO: 220 - DNA, 28 bp, artificial sequence
  Synthetic
gtgaactgccgagtaggtagctgataac

SEQ ID NO: 221 - DNA, 32 bp, artificial sequence
  Synthetic
tgaagataggtctggtcggcgaagaaaccgcc

SEQ ID NO: 222 - RNA, 60 nt, artificial sequence
  Synthetic
cugauaacugaagauaggucuggucggcgaagaaaccgccgugaacugccgaguagguag

SEQ ID NO: 223 - DNA, 28 bp, artificial sequence
  Synthetic
gtgaactgccgagtaggtagctgataac

SEQ ID NO: 224 - DNA, 32 bp, artificial sequence
  Synthetic
agcctgtaatctctgcttaaaagcacagaatc

SEQ ID NO: 225 - RNA, 60 nt, artificial sequence
  Synthetic
cugauaacagccuguaaucucugcuuaaaagcacagaaucgugaacugccgaguagguag

SEQ ID NO: 226 - DNA, 28 bp, artificial sequence
  Synthetic
gtgaactgccgagtaggtagctgataac

SEQ ID NO: 227 - DNA, 32 bp, artificial sequence
  Synthetic
tgagattttcactcgtcagtgtgaacacaatt

SEQ ID NO: 228 - RNA, 60 nt, artificial sequence
  Synthetic
cugauaacugagauuuucacucgucagugugaacacaauugugaacugccgaguagguag

SEQ ID NO: 229 - DNA, 28 bp, artificial sequence
  Synthetic
gtgaactgccgagtaggtagctgataac

SEQ ID NO: 230 - DNA, 32 bp, artificial sequence
  Synthetic
gtacagcgcggctgaaatcatcattaaagcga

SEQ ID NO: 231 - RNA, 60 nt, artificial sequence
  Synthetic
cugauaacguacagcgcggcugaaaucaucauuaaagcgagugaacugccgaguagguag

SEQ ID NO: 232 - DNA, 28 bp, artificial sequence
  Synthetic
gtgaactgccgagtaggtagctgataac

SEQ ID NO: 233 - DNA, 32 bp, artificial sequence
  Synthetic
tacagcgcggctgaaatcatcattaaagcgag

SEQ ID NO: 234 - RNA, 60 nt, artificial sequence
  Synthetic
cugauaacuacagcgcggcugaaaucaucauuaaagcgaggugaacugccgaguagguag

SEQ ID NO: 235 - DNA, 28 bp, artificial sequence
  Synthetic
gtgaactgccgagtaggtagctgataac

SEQ ID NO: 236 - DNA, 32 bp, artificial sequence
  Synthetic
acagcgcggctgaaatcatcattaaagcgagt

SEQ ID NO: 237 - RNA, 60 nt, artificial sequence
  Synthetic
cugauaacacagcgcggcugaaaucaucauuaaagcgagugugaacugccgaguagguag

SEQ ID NO: 238 - DNA, 28 bp, artificial sequence
  Synthetic
gtgaactgccgagtaggtagctgataac

SEQ ID NO: 239 - DNA, 32 bp, artificial sequence
  Synthetic
cagcgcggctgaaatcatcattaaagcgagtg

SEQ ID NO: 240 - RNA, 60 nt, artificial sequence
  Synthetic
cugauaaccagcgcggcugaaaucaucauuaaagcgaguggugaacugccgaguagguag

SEQ ID NO: 241 - DNA, 28 bp, artificial sequence
  Synthetic
gtgaactgccgagtaggtagctgataac

SEQ ID NO: 242 - DNA, 32 bp, artificial sequence
  Synthetic
agcgcggctgaaatcatcattaaagcgagtgg

SEQ ID NO: 243 - RNA, 60 nt, artificial sequence
  Synthetic
cugauaacagcgcggcugaaaucaucauuaaagcgagugggugaacugccgaguagguag

SEQ ID NO: 244 - DNA, 28 bp, artificial sequence
  Synthetic
gtgaactgccgagtaggtagctgataac

SEQ ID NO: 245 - DNA, 32 bp, artificial sequence
  Synthetic
gcgcggctgaaatcatcattaaagcgagtggc

SEQ ID NO: 246 - RNA, 60 nt, artificial sequence
  Synthetic
cugauaacgcgcggcugaaaucaucauuaaagcgaguggcgugaacugccgaguagguag

SEQ ID NO: 247 - DNA, 28 bp, artificial sequence
  Synthetic
gtgaactgccgagtaggtagctgataac

SEQ ID NO: 248 - DNA, 32 bp, artificial sequence
  Synthetic
cgcggctgaaatcatcattaaagcgagtggca

SEQ ID NO: 249 - RNA, 60 nt, artificial sequence
  Synthetic
cugauaaccgcggcugaaaucaucauuaaagcgaguggcagugaacugccgaguagguag

SEQ ID NO: 250 - DNA, 28 bp, artificial sequence
  Synthetic
gtgaactgccgagtaggtagctgataac

SEQ ID NO: 251 - DNA, 32 bp, artificial sequence
  Synthetic
gcggctgaaatcatcattaaagcgagtggcaa

SEQ ID NO: 252 - RNA, 60 nt, artificial sequence
  Synthetic
cugauaacgcggcugaaaucaucauuaaagcgaguggcaagugaacugccgaguagguag

SEQ ID NO: 253 - DNA, 28 bp, artificial sequence
  Synthetic
gtgaactgccgagtaggtagctgataac

SEQ ID NO: 254 - DNA, 32 bp, artificial sequence
  Synthetic
cggctgaaatcatcattaaagcgagtggcaac

SEQ ID NO: 255 - RNA, 60 nt, artificial sequence
  Synthetic
cugauaaccggcugaaaucaucauuaaagcgaguggcaacgugaacugccgaguagguag

SEQ ID NO: 256 - DNA, 28 bp, artificial sequence
  Synthetic
gtgaactgccgagtaggtagctgataac

SEQ ID NO: 257 - DNA, 32 bp, artificial sequence
  Synthetic
ggctgaaatcatcattaaagcgagtggcaaca

SEQ ID NO: 258 - RNA, 60 nt, artificial sequence
  Synthetic
cugauaacggcugaaaucaucauuaaagcgaguggcaacagugaacugccgaguagguag

SEQ ID NO: 259 - DNA, 28 bp, artificial sequence
  Synthetic
gtgaactgccgagtaggtagctgataac

SEQ ID NO: 260 - DNA, 32 bp, artificial sequence
  Synthetic
gctgaaatcatcattaaagcgagtggcaacat

SEQ ID NO: 261 - RNA, 60 nt, artificial sequence
  Synthetic
cugauaacgcugaaaucaucauuaaagcgaguggcaacaugugaacugccgaguagguag

SEQ ID NO: 262 - DNA, 28 bp, artificial sequence
  Synthetic
gtgaactgccgagtaggtagctgataac

SEQ ID NO: 263 - DNA, 32 bp, artificial sequence
  Synthetic
ctgaaatcatcattaaagcgagtggcaacatg

SEQ ID NO: 264 - RNA, 60 nt, artificial sequence
  Synthetic
cugauaaccugaaaucaucauuaaagcgaguggcaacauggugaacugccgaguagguag

SEQ ID NO: 265 - DNA, 28 bp, artificial sequence
  Synthetic
gtgaactgccgagtaggtagctgataac

SEQ ID NO: 266 - DNA, 32 bp, artificial sequence
  Synthetic
tgaaatcatcattaaagcgagtggcaacatgg

SEQ ID NO: 267 - RNA, 60 nt, artificial sequence
  Synthetic
cugauaacugaaaucaucauuaaagcgaguggcaacaugggugaacugccgaguagguag

SEQ ID NO: 268 - DNA, 28 bp, artificial sequence
  Synthetic
gtgaactgccgagtaggtagctgataac

SEQ ID NO: 269 - DNA, 32 bp, artificial sequence
  Synthetic
gaaatcatcattaaagcgagtggcaacatgga

SEQ ID NO: 270 - RNA, 60 nt, artificial sequence
  Synthetic
cugauaacgaaaucaucauuaaagcgaguggcaacauggagugaacugccgaguagguag

SEQ ID NO: 271 - DNA, 28 bp, artificial sequence
  Synthetic
gtgaactgccgagtaggtagctgataac

SEQ ID NO: 272 - DNA, 32 bp, artificial sequence
  Synthetic
aaatcatcattaaagcgagtggcaacatggaa

SEQ ID NO: 273 - RNA, 60 nt, artificial sequence
  Synthetic
cugauaacaaaucaucauuaaagcgaguggcaacauggaagugaacugccgaguagguag

SEQ ID NO: 274 - DNA, 28 bp, artificial sequence
  Synthetic
gtgaactgccgagtaggtagctgataac

SEQ ID NO: 275 - DNA, 32 bp, artificial sequence
  Synthetic
aatcatcattaaagcgagtggcaacatggaaa

SEQ ID NO: 276 - RNA, 60 nt, artificial sequence
  Synthetic
cugauaacaaucaucauuaaagcgaguggcaacauggaaagugaacugccgaguagguag

SEQ ID NO: 277 - DNA, 28 bp, artificial sequence
  Synthetic
gtgaactgccgagtaggtagctgataac

SEQ ID NO: 278 - DNA, 32 bp, artificial sequence
  Synthetic
tcatcagcgcggctgaaatcatcattaaagcg

SEQ ID NO: 279 - RNA, 60 nt, artificial sequence
  Synthetic
cugauaacucaucagcgcggcugaaaucaucauuaaagcggugaacugccgaguagguag

SEQ ID NO: 280 - DNA, 28 bp, artificial sequence
  Synthetic
gtgaactgccgagtaggtagctgataac

SEQ ID NO: 281 - DNA, 32 bp, artificial sequence
  Synthetic
agtagtcggcggctgaaatcatcattaaagcg

SEQ ID NO: 282 - RNA, 60 nt, artificial sequence
  Synthetic
cugauaacaguagucggcggcugaaaucaucauuaaagcggugaacugccgaguagguag

SEQ ID NO: 283 - DNA, 28 bp, artificial sequence
  Synthetic
gtgaactgccgagtaggtagctgataac

SEQ ID NO: 284 - DNA, 32 bp, artificial sequence
  Synthetic
agtacagccgccctgaaatcatcattaaagcg

SEQ ID NO: 285 - RNA, 60 nt, artificial sequence
  Synthetic
cugauaacaguacagccgcccugaaaucaucauuaaagcggugaacugccgaguagguag

SEQ ID NO: 286 - DNA, 28 bp, artificial sequence
  Synthetic
gtgaactgccgagtaggtagctgataac

SEQ ID NO: 287 - DNA, 32 bp, artificial sequence
  Synthetic
agtacagcgcgggactaatcatcattaaagcg

SEQ ID NO: 288 - RNA, 60 nt, artificial sequence
  Synthetic
cugauaacaguacagcgcgggacuaaucaucauuaaagcggugaacugccgaguagguag

SEQ ID NO: 289 - DNA, 28 bp, artificial sequence
  Synthetic
gtgaactgccgagtaggtagctgataac

SEQ ID NO: 290 - DNA, 32 bp, artificial sequence
  Synthetic
agtacagcgcggctgattagatcattaaagcg

SEQ ID NO: 291 - RNA, 60 nt, artificial sequence
  Synthetic
cugauaacaguacagcgcggcugauuagaucauuaaagcggugaacugccgaguagguag

SEQ ID NO: 292 - DNA, 28 bp, artificial sequence
  Synthetic
gtgaactgccgagtaggtagctgataac

SEQ ID NO: 293 - DNA, 32 bp, artificial sequence
  Synthetic
agtacagcgcggctgaaatctagtttaaagcg

SEQ ID NO: 294 - RNA, 60 nt, artificial sequence
  Synthetic
cugauaacaguacagcgcggcugaaaucuaguuuaaagcggugaacugccgaguagguag

SEQ ID NO: 295 - DNA, 28 bp, artificial sequence
  Synthetic
gtgaactgccgagtaggtagctgataac

SEQ ID NO: 296 - DNA, 32 bp, artificial sequence
  Synthetic
agtacagcgcggctgaaatcatcaaattagcg

SEQ ID NO: 297 - RNA, 60 nt, artificial sequence
  Synthetic
cugauaacaguacagcgcggcugaaaucaucaaauuagcggugaacugccgaguagguag

SEQ ID NO: 298 - DNA, 28 bp, artificial sequence
  Synthetic
gtgaactgccgagtaggtagctgataac

SEQ ID NO: 299 - DNA, 32 bp, artificial sequence
  Synthetic
agtacagcgcggctgaaatcatcattaatcgc

SEQ ID NO: 300 - RNA, 60 nt, artificial sequence
  Synthetic
cugauaacaguacagcgcggcugaaaucaucauuaaucgcgugaacugccgaguagguag

SEQ ID NO: 301 - DNA, 28 bp, artificial sequence
  Synthetic
gtgaactgccgagtaggtagctgataac

SEQ ID NO: 302 - DNA, 8 bp, artificial sequence
  Synthetic
agtacagc

SEQ ID NO: 303 - RNA, 36 nt, artificial sequence
  Synthetic
cugauaacaguacagcgugaacugccgaguagguag

SEQ ID NO: 304 - DNA, 28 bp, artificial sequence
  Synthetic
gtgaactgccgagtaggtagctgataac

SEQ ID NO: 305 - DNA, 14 bp, artificial sequence
  Synthetic
agtacagcgcggct

SEQ ID NO: 306 - RNA, 42 nt, artificial sequence
  Synthetic
cugauaacaguacagcgcggcugugaacugccgaguagguag

SEQ ID NO: 307 - DNA, 28 bp, artificial sequence
  Synthetic
gtgaactgccgagtaggtagctgataac

SEQ ID NO: 308 - DNA, 20 bp, artificial sequence
  Synthetic
agtacagcgcggctgaaatc

SEQ ID NO: 309 - RNA, 48 nt, artificial sequence
  Synthetic
cugauaacaguacagcgcggcugaaaucgugaacugccgaguagguag

SEQ ID NO: 310 - DNA, 28 bp, artificial sequence
  Synthetic
gtgaactgccgagtaggtagctgataac

SEQ ID NO: 311 - DNA, 26 bp, artificial sequence
  Synthetic
agtacagcgcggctgaaatcatcatt

SEQ ID NO: 312 - RNA, 54 nt, artificial sequence
  Synthetic
cugauaacaguacagcgcggcugaaaucaucauugugaacugccgaguagguag

SEQ ID NO: 313 - DNA, 28 bp, artificial sequence
  Synthetic
gtgaactgccgagtaggtagctgataac

SEQ ID NO: 314 - DNA, 38 bp, artificial sequence
  Synthetic
agtacagcgcggctgaaatcatcattaaagcgagtggc

SEQ ID NO: 315 - RNA, 66 nt, artificial sequence
  Synthetic
cugauaacaguacagcgcggcugaaaucaucauuaaagcgaguggcgugaacugccgaguagguag

SEQ ID NO: 316 - DNA, 28 bp, artificial sequence
  Synthetic
gtgaactgccgagtaggtagctgataac

SEQ ID NO: 317 - DNA, 44 bp, artificial sequence
  Synthetic
agtacagcgcggctgaaatcatcattaaagcgagtggcaacatg

SEQ ID NO: 318 - RNA, 72 nt, artificial sequence
  Synthetic
cugauaacaguacagcgcggcugaaaucaucauuaaagcgaguggcaacauggugaacugccgaguagguag

SEQ ID NO: 319 - DNA, 28 bp, artificial sequence
  Synthetic
gtgaactgccgagtaggtagctgataac

SEQ ID NO: 320 - DNA, 50 bp, artificial sequence
  Synthetic
agtacagcgcggctgaaatcatcattaaagcgagtggcaacatggaaatc

SEQ ID NO: 321 - RNA, 78 nt, artificial sequence
  Synthetic
cugauaacaguacagcgcggcugaaaucaucauuaaagcgaguggcaacauggaaaucgugaacugccgaguagguag

SEQ ID NO: 322 - DNA, 28 bp, artificial sequence
  Synthetic
gtgaactgccgagtaggtagctgataac

SEQ ID NO: 323 - DNA, 56 bp, artificial sequence
  Synthetic
agtacagcgcggctgaaatcatcattaaagcgagtggcaacatggaaatcgctgat

SEQ ID NO: 324 - RNA, 84 nt, artificial sequence
  Synthetic
cugauaacaguacagcgcggcugaaaucaucauuaaagcgaguggcaacauggaaaucgcugaugugaacugccgaguagguag

SEQ ID NO: 325 - DNA, 28 bp, artificial sequence
  Synthetic
gtgaactgccgagtaggtagctgataac

SEQ ID NO: 326 - DNA, 32 bp, artificial sequence
  Synthetic
ttacaggacgctttggcttcattgcttttcag

SEQ ID NO: 327 - RNA, 60 nt, artificial sequence
  Synthetic
cugauaacuuacaggacgcuuuggcuucauugcuuuucaggugaacugccgaguagguag

SEQ ID NO: 328 - DNA, 20 bp, artificial sequence
  Synthetic
ggagaccagtctaggtctcg

SEQ ID NO: 329 - RNA, 104 nt, artificial sequence
  Synthetic
gggagaccagucuaggucucgguuuuagagcuagaaauagcaaguuaaaauaaggcuaguccguuaucaacuugaaaaaguggcaccgagucggugcuuuuuuu

SEQ ID NO: 330 - DNA, 20 bp, artificial sequence
  Synthetic
cggattgaccgtaatgggat

SEQ ID NO: 331 - RNA, 104 nt, artificial sequence
  Synthetic
gcggauugaccguaaugggauguuuuagagcuagaaauagcaaguuaaaauaaggcuaguccguuaucaacuugaaaaaguggcaccgagucggugcuuuuuuu

SEQ ID NO: 332 - DNA, 20 bp, artificial sequence
  Synthetic
tgatttcagccgcgctgtac

SEQ ID NO: 333 - RNA, 104 nt, artificial sequence
  Synthetic
gugauuucagccgcgcuguacguuuuagagcuagaaauagcaaguuaaaauaaggcuaguccguuaucaacuugaaaaaguggcaccgagucggugcuuuuuuu

SEQ ID NO: 334 - DNA, 28 bp, artificial sequence
  Synthetic
gttcactgccgtataggcagctaagaaa

SEQ ID NO: 335 - DNA, 20 bp, artificial sequence
  Synthetic
cgagacctcaattggtctcc

SEQ ID NO: 336 - RNA, 48 nt, artificial sequence
  Synthetic
cuaagaaacgagaccucaauuggucuccguucacugccguauaggcag

SEQ ID NO: 337 - DNA, 28 bp, artificial sequence
  Synthetic
gttcactgccgtataggcagctaagaaa

SEQ ID NO: 338 - DNA, 32 bp, artificial sequence; identical to SEQ ID NO: 164
  Synthetic

SEQ ID NO: 339 - RNA, 60 nt, artificial sequence
  Synthetic
cuaagaaauaucccauuacggucaauccgccguuuguuccguucacugccguauaggcag

SEQ ID NO: 340 - DNA, 28 bp, artificial sequence
  Synthetic
gttcactgccgtataggcagctaagaaa

SEQ ID NO: 341 - DNA, 32 bp, artificial sequence; identical to SEQ ID NO: 167
  Synthetic

SEQ ID NO: 342 - RNA, 60 nt, artificial sequence
  Synthetic
cuaagaaaaguacagcgcggcugaaaucaucauuaaagcgguucacugccguauaggcag

SEQ ID NO: 343 - DNA, 20 bp, artificial sequence
  Synthetic
gtggtattcactccagagcg

SEQ ID NO: 344 - DNA, 18 bp, artificial sequence
  Synthetic
caacagtactgcgatgag

SEQ ID NO: 345 - DNA, 17 bp, artificial sequence
  Synthetic
cgaacctgttcaacgac

SEQ ID NO: 346 - DNA, 16 bp, artificial sequence
  Synthetic
cgaactgctgtcgaag

SEQ ID NO: 347 - DNA, 20 bp, artificial sequence
  Synthetic
gcccgagtttgtcagaaagc

SEQ ID NO: 348 - DNA, 19 bp, artificial sequence
  Synthetic
cgtcctgtggatcctctac

SEQ ID NO: 349 - DNA, 18 bp, artificial sequence
  Synthetic
gcatcaacgcatatagcg

SEQ ID NO: 350 - DNA, 20 bp, artificial sequence
  Synthetic
catgcagtattccaggactc

SEQ ID NO: 351 - DNA, 19 bp, artificial sequence
  Synthetic
ggagagcaaatcttgttgc

SEQ ID NO: 352 - DNA, 19 bp, artificial sequence
  Synthetic
caccacagatgaaacgccg

SEQ ID NO: 353 - DNA, 19 bp, artificial sequence
  Synthetic
cgccgcacatctgaacttc

SEQ ID NO: 354 - DNA, 21 bp, artificial sequence
  Synthetic
gtctgaatttgacctgagcgc

SEQ ID NO: 355 - DNA, 20 bp, artificial sequence
  Synthetic
catgcagtattccaggactc

SEQ ID NO: 356 - DNA, 19 bp, artificial sequence
  Synthetic
ggagagcaaatcttgttgc

SEQ ID NO: 357 - DNA, 21 bp, artificial sequence
  Synthetic
gcgctcaggtcaaattcagac

SEQ ID NO: 358 - DNA, 20 bp, artificial sequence
  Synthetic
ggagtgacggcagttatctg

SEQ ID NO: 359 - DNA, 19 bp, artificial sequence
  Synthetic
cgccgcacatctgaacttc

SEQ ID NO: 360 - DNA, 24 bp, artificial sequence
  Synthetic
ctgaagtttagaccatgaagaggc

SEQ ID NO: 361 - DNA, 24 bp, artificial sequence
  Synthetic
ggttgttttgtggttaagttgctg

SEQ ID NO: 362 - DNA, 51 bp, artificial sequence
  Synthetic
ctctttccctacacgacgctcttccgatctgcattgtttgttggctacgag

SEQ ID NO: 363 - DNA, 56 bp, artificial sequence
  Synthetic
ctctttccctacacgacgctcttccgatctgtttgtaattgactgaatatcaacgc

SEQ ID NO: 364 - DNA, 60 bp, artificial sequence
  Synthetic
ctctttccctacacgacgctcttccgatctggtgacagttatatgtaaggaatatgacag

SEQ ID NO: 365 - DNA, 55 bp, artificial sequence
  Synthetic
ctctttccctacacgacgctcttccgatctgctactttttctctgtcacagaatg

SEQ ID NO: 366 - DNA, 48 bp, artificial sequence
  Synthetic
ctctttccctacacgacgctcttccgatctcaccacagatgaaacgcc

SEQ ID NO: 367 - DNA, 52 bp, artificial sequence
  Synthetic
ctctttccctacacgacgctcttccgatctcatcattaaagcgagtggcaac

SEQ ID NO: 368 - DNA, 56 bp, artificial sequence
  Synthetic
gactggagttcagacgtgtgctcttccgatctctgaagtttagaccatgaagaggc

SEQ ID NO: 369 - DNA, 56 bp, artificial sequence
  Synthetic
gactggagttcagacgtgtgctcttccgatctggttgttttgtggttaagttgctg

SEQ ID NO: 370 - DNA, 48 bp, artificial sequence
  Synthetic
ctggagttcagacgtgtgctcttccgatctgcgtttctacctgcaggg

SEQ ID NO: 371 - DNA, 32 bp, artificial sequence
  Synthetic
  misc_feature (31)..(32): n is a, c, g, or t
ctctttccctacacgacgctcttccgatctnn

SEQ ID NO: 372 - DNA, 30 bp, artificial sequence
  Synthetic
  misc_feature (1)..(1): phosphorylation
agatcggaagagcgtcgtgtagggaaagag

SEQ ID NO: 373 - DNA, 22 bp, artificial sequence
  Synthetic
acactctttccctacacgacgc

SEQ ID NO: 374 - DNA, 31 bp, artificial sequence
  Synthetic
  misc_feature (1)..(1): adenylation
  modified_base (31)..(31): dideoxy Cytosine monophosphate
agatcggaagagcacacgtctgaactccagc

SEQ ID NO: 375 - DNA, 30 bp, artificial sequence
  Synthetic
ctggagttcagacgtgtgctcttccgatct

SEQ ID NO: 376 - RNA, 30 nt, artificial sequence
  Synthetic
cucuuucccuacacgacgcucuuccgaucu

SEQ ID NO: 377 - DNA, 59 bp, artificial sequence
  Synthetic
  misc_feature (30)..(37): n is a, c, g, or t
aatgatacggcgaccaccgagatctacacnnnnnnnnacactctttccctacacgacgc

SEQ ID NO: 378 - DNA, 55 bp, artificial sequence
  Synthetic
  misc_feature (25)..(32): n is a, c, g, or t
caagcagaagacggcatacgagatnnnnnnnngtgactggagttcagacgtgtgc

SEQ ID NO: 379 - DNA, 24 bp, artificial sequence
  Synthetic
catctacaccaacgtgacctatcc

SEQ ID NO: 380 - DNA, 4 bp, artificial sequence
  Synthetic
gttt

SEQ ID NO: 381 - DNA, 4 bp, artificial sequence
  Synthetic
gttg

SEQ ID NO: 382 - DNA, 4 bp, artificial sequence
  Synthetic
tttg

SEQ ID NO: 383 - DNA, 4 bp, artificial sequence
  Synthetic
tttc

SEQ ID NO: 384 - DNA, 4 bp, artificial sequence
  Synthetic
cttc

SEQ ID NO: 385 - DNA, 4 bp, artificial sequence
  Synthetic
tttt

SEQ ID NO: 386 - DNA, 20 bp, artificial sequence
  Synthetic
cgagacctcaattggtctcc

SEQ ID NO: 387 - DNA, 37 bp, artificial sequence
  Synthetic
caccctgccataaagaaactgttacccgtaggtagtc

SEQ ID NO: 388 - DNA, 37 bp, artificial sequence
  Synthetic
ccactcgctttaatgatgatttcagccgcgctgtact

SEQ ID NO: 389 - DNA, 37 bp, artificial sequence
  Synthetic
tgtagtcggtttatgcagcaacgagacgtcacggaaa

SEQ ID NO: 390 - DNA, 37 bp, artificial sequence
  Synthetic
atctgtggtgcaacgggcgctgggtcggttacggcca

SEQ ID NO: 391 - DNA, 37 bp, artificial sequence
  Synthetic
cagataactgccgtcactccagcgcagcaccatcacc

SEQ ID NO: 392 - DNA, 37 bp, artificial sequence
  Synthetic
ccgtgacgtctcgttgctgcataaaccgactacacaa

SEQ ID NO: 393 - DNA, 6858 bp, artificial sequence; identical to SEQ ID NO: 6
  Synthetic

SEQ ID NO: 394 - DNA, 7897 bp, artificial sequence
  Synthetic
ttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactatagcggattgaccgtaatgggatgttttagagctagaaatagcaagttaaaataaggctagtccgttatcaacttgaaaaagtggcaccgagtcggtgctttttttggtagtgcagcgcgatcgtaatcaggatcccatggtacgcgtgctagaggcatcaaataaaacgaaaggctcagtcgaaagactgggcctttcgttttatctgttgtttgtcggtgaacgctctcctgagtaggacaaatggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggataagaaatactcaataggcttagctatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatgccattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactaatagcctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggc

SEQ ID NO: 395 - DNA, 8532 bp, artificial sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgctgaaatcatcattaaagcgagtggcaacatgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtccggtagcgaaacgccggggacttctgaatctgctactccggaaagcggaggctctggctcgtcaggaggttcaggaagttcaggcggtatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 396 - DNA, 6417 bp, artificial sequence
  Synthetic
cataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggcctggatgatcctgataagggcaatcaagagccagaaacgcatgagatagtgactgagctatcactagatgagcagcatttgctggaaatgattcagaaactaatagaaccgtgcgatcgtatcacctatggagaaagacaaagggaagttgcaggaaaactaggcaagtctgtacggacagtaaggcgtttggtgaaaaaatgggaacaggagggtttaactgcacttcaaactgcgacaagaactgataaaggaacacatcgaatagattcggattggcaggacttcattatcaagacatataaggaaaataataaagatggaaaacgaatgtctcccaaacaagtggcgctcagagttcaaacaaaggctgaggaattaggtcaacaaaaatatcccagttatagaactgtgtatcgagttttacaacctatcatcgaacagaaagaacaaaaagagggtattagacatcggggttggcatggttctcgattatcagttaaaactcgcgatggcaaagacttatttgtggaacacagcaatcatgtttggcagtgtgatcacactcgtgtagacctattactggtagatcagcacggtgaacttttgagtcgtccttggttgacaatagttgtagatacttactcccgttgcattatggggataaatttgggttttgatgccccaagttcccaggtaatagcattggcactgcgtcatgcaattttgcctaagcgatatggatcagaatatggactccatgaagaatggggaacctatggtaaaccagaacatttttatactgatggcggtaaagattttcgctccaaccatttgcaacagataggtgtgcagttggggtttgtttgtcatttacgcgatcgccccagtgaaggtggtattgttgagcgtccttttggaacttttaacactgatttattttcaaccttgccaggatacacaggttcaaatgtacaggaacgccctgagcaagctgagaaagaggcttgtattactttgagggaattagaacgtctgctagtacgttacatcgtggataaatacaaccaaagtattgatgctcgattaggcgaccaaactcgttatcaacgttgggaagcaggattaattgttgcgcctaatttaatttcagaagaagaattacgtatctgcctgatgaagcaaactcgacgctcaatttacaggggtgggtatgtgcaatttgaaaatctgacttatcggggagaaaatttggcaggttatgcaggtgaaaatgttgtactgcgttatgaccccaaagacatcaccactttgttggtttaccgccagaaaggtaatcaagaagaatttctagctcgtgcttatgctcaagatttggagacagaggaattgtctgtggatgaagcaaaagctatgagtcgccggattcggcaagcaggtaaggctattagcaatcgttctattttggcagaggtgcgcgatcgcgaaaccttcgtgaaccaaaagaaaaccaaaaaggaacgccaaaaggcagaacagaccatagttcaaaaggctaaaaaacctgtgcctgttgaaccagaggaagaaattgaagtggcatctgttgacagtgaaccagaataccagatgccggaagtctttgattacgaacaaatgcgtgaagattacgggtggtagtaaaggaggtaaataatgacttcaaaacaggctcaagctgttgcccaacagttgggagatattccggtaaatgacgaaaaaatacaagcggaaattcaacgattgaaccggaagagttttattcccttggaacaagtacaaatgcttcatgattggttagatggaaagcgacaatcacggcagtctggtcgagtggtgggggagtcaagaacaggcaaaactatgggttgtgatgcctacagattacgccataaaccaaagcaagaaccaggacgacctccaactgttcctgttgcttatattcaaatcccgcaagaatgcggtgcaaaggaattgtttggagtcctccttgaacatttgaagtatcaaatgacaaagggaacagtagccgaaatcagggacagaacgctacgagttcttaaagggtgtggagtggaaatgcttattattgatgaggctgaccgcttgaaacccaaaacttttgctgaggtgccggacatttttgacaaattagaaatagcagtgattttggtaggaactgaccgcttagatgcagtaattaagcgggacgaacaagtttacaaccgttttcgggcttgtcatcgatttggtaagttttctggggatgaatttaagaagatagtagacatttgggaaaagaaggttttgcagttgccagttgcttccaatctttccagtaagactatgctgaaaactttaggtgagacaacggggggttatattggtttgctcgacatgattctgagagaatctgctatccgggcattgaagaaaggattacggaaggtggatttggcaaccctgaaggaagtgacagaagagtacaaataatagaggaggatataaatggaagttccacagattcaaccttggctgtttcaaatagaaccgttagagggagaaagtttgagtcactttttaggacgttttcgacgtgcaaatgatttaacacctactggtttaggtaaagctgctggacttggaggtgcgatcgctcgttgggaaaagtttcgatttaatcccccaccgtctcgccagcagttggaggctttggctaatgttgtcggggttgatgccgataggttagcgcaaatgttaccatctgctggggtggggatgaaaatggagccaattcggttatgtgctgcttgttatgccgagtcgccatgtcacaagattgaatggcaatttaaggtaacgcgagggtgcgcgaggcacaaaataactttattgtcagaatgtcctaactgcaaggcaagatttaaggttccagcattatgggtggatggttggtgtaatcgttgctttttacggtttgaggagatggctaagtatcagaaagggttgtagtaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaataga

SEQ ID NO: 397 - DNA, 6384 bp, artificial sequence
  Synthetic
gttttgattcttggatattaatgcttgatccttatcaaggagaaagcatcagtcattttctaggaagatttagacgtgagaatagtcttaccgttaataatttagggaaagcaaccgaactttatggagcgatcgcccgttgggaaaagtttcgttttaatcctcctccttcctctgaacagttgaaaaagttaagtgcgatcgtacaagtagaagtagcaaccttacaaacaatgtttccttccgccccgatgaaaatgactcccattcgcctttgttcggcttgttatggagaaaagccctatcataagatggaatggcagtataaggagatttacaagtgcgatcgacatcaactgaaacttttatcagaatgtcctaactgtggggcaagattcaagtttcctagtctatgggtggatggttggtgtcacagatgttttactccttttgcagagatgaaacaacaaaaagattagtaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggcaccatcgataatcaattttctgattctccagaattgatctctcaactttctcccgaggaccaaaaaatcgctgatgttattgaaaatttacttcaaccttgtgacaagaaaacttatggaaaaaagttaaaacaagcatcagatcagttgaagaagtcggttagaactattcaaagatacgttaagcagtgggaagaaaatggtttagtcggtattcttcaaaataatcgagccgataaaggctcttatcgtattgacccccgcttacaggatttcattcttaaaacctatcgtgaaggaaacaaaggtagtaaacgaatgacgcctaaacaggtttatttacgagcagttgtccaagcagaaaattgggggatcaaacctccctctcacatgactatttatcggattttgaatcctattattgcggaaaaagaaaataagaaaaggattagaagttctgggtggagaggttctcagttagttctttctactcgctcaggtacagaaatcgatgtacagtatagtaaccatgtttggcaatgtgatcatactcgtgcagatattcttttggtagatcaatttggtgaattattgggcagaccttggataacgatagtggtagatacttattctcgctgtattatgggtattaatcttggttttgatgctcccagttcccaagtggtcactcttgctttacgtcatgccattttgcctaagagttacagttctgattatgaactacatgaggaatggggaacttatggtaaaccagagtacttttacactgatgggggtaaggattttcgttctaatcatcttcaacaaattagcttacaactgggttttacttgtcatctaaggagtcgccccagtgaagggggagtagtagagcgtctttttaaaactttgaacacggaggttttttctactctaccaggatatacaggagcaaatgtacaagaacgtccagaagatgcagaaaaagaagcctgtctcactcttaaagagctagaaatacttatagttcgctatatcgttgataactacaaccaacgtattgatgctcgtatgggagagcaaactcgctttcagcgttgggagtcaggattgctttctactcctcatatcatacctgaacgtgaattagatatttgtttgatgaaacagtcacgcagaaaagttcaaaagggtggtcatcttcaatttgaaaacttgatctataagggtcagtatttagcaggttatgaaggagagacagttattcttcgttatgatccaagggatattacgggtattttgatttatcgtgttgagaataataaagaaatttttcttactcgtgcttatgccacggatttagaaggggactgtttatccttaacggatgcgaaatctagtgttaagagaattagagagaagtctaaaaatgttcataataagtcaattttaatggaaattcaacaacgtcatttattttcagaaaagaaaaccaagaagcaaattcagcaagaagaacaaaaacaaattaaaccaaatacttctctatctatcttcaaaccagaaactgagatggatacgcaggttgaatcatcacaggagctatcagaggaggacttggatattgaaatgattgactacggtaatttacaacaatactaatagaggaggatataaatggaagcgaaagaaattgctcaacagttgggagaggttgaacagccaaatcagtctttgcagaatgaactggatcgactatcaaaaaaacaatttctgtttttagatcaggtaaaaatctatcaccaatggttgaatgaaagattattcatgaaacattgttgccgagttgtgggggattcacacacgggcaaaacctcgtcatctcaagcctactgtctaagatataaatctactcaagagtcggggaaaaatcctatttttcccgtgttatatgtttctgtccccgaaaatgcaacttcaaaagtcttttttgagacatcaattaagagtttcggttatcgaatcagtaagggtacgatttccgatttaagagaacgaatgctgacattactgtccagatgtcaggttaaaatgatgattattgatgaggctgaccgatgtaaacctgaaactctgagttatatacgagatatattcgatcatctcaacatttgtattgttttggtgggtacagatcgacttaatacggtacttaaaagggatgagcaagtctataatcgttttttaccgtgttatcgctatggtcttttagataaagaatcccttattaaaacaataaaaatttgggaaattaaaattttaaaacttcctgtagcatctaatttaagtcagggcaaaaagtttaacattatttattctacttctaaaggatgtttaggaacaatggataaattgttgagaacatctgcttctatggctttaattagaggtttatcgaagattgaattgaatatattggaagaagcagcgcacttgttcaaagataagtgataaaggaggtaaataatgattacaaata

SEQ ID NO: 398 - DNA, 6762 bp, artificial sequence
  Synthetic
cgggatctcgacgctctcccttatgcgactcctgcattaggaaattaatacgactcactataggggaattgtgagcggataacaattcccctgtagaaataattttgtttaactttaataaggagatataccatgggctctacagacgctacctcggcaacttgctccccttctcaggattcgggtttggaacaggggcagcaggggcaaccccccatgcttctcaatgaggtttcgccggaggtgcaacagaaaattgatttaattgatgctatctttcaaactcctgacaagaaagctcgacgtgaagcgattctacatgccgcaaagacattgggcaaaacgactcgaaccatccggctcatgatggaaaaggtcaagaatgacggagttgccacgctggcagtcggtcgtaaggatgaaggacagttccgcatctctgagcagtggtctaactttattaaagtgatttatgaatggggacagcgagacggttcgcggatcaatatcaatggagtatatacccatttggtcgctcttgcctctcaaggagaagcattgcgggataaaaagtacgccgatcgctttaagggttatccccaggtacttgaggatctagttgcaggaaaacatccctctcatgtcactgtttataaagttgttaatttttatcttgagcgaaaaaacaaaaaggttcgccatccgggttcacctgccgaaggacaagttatccaaaccacggaagggatcatagagctaactcacagtaatcaggtttggcaatgtgaccacactaaacttgatattttgctggtggatggtgatggggaagtaattttacaatgggatgaccaaaagcaagagattgttggtcgcccttatctaacattgatcatggatagttattccggctgtgtcgcagggtttcacctgggctttgaggcagcaggttcgcatgaagtgggtttagctttgcgccatgcgatgttacccaaacagtatggctccgagtacaaacttaaagcggagtggaatgtttttggcgtgccagagtattggctgaccgatcgggcgaaggagttcaagtccaatcatttgaagcaagtctcaatgcaagtaggcttcaagcgtagattgcgggcttttccatccgcagggggactcattgaatccattttcgacaagattaataaagaagtcttgtcccactttggaggctacacaggctcgaacattacaaaacgccctaaagaagcggaaaagcatgcatgtctgacgttggatgagctagagaagagactggtgatatactttgttgatcattacaacggacatgattacccaaaggtagccaatcaaaagcgatcgaaccgctggaaggcaaacctactgacagagccagaggtgctggatgaacgtgagcttgacatctgcctgatgaaagttgcccatcgcaaagttgaaaagtacggttgcattcggtttgagggacttgtgtatcagggagactgtctcgtagagtatgagggggatgaggtgtctctgaggtacgatgagcgcaacattcttgcgcttttggcttacgaacgacctcagcgcgatcgaccaggcaagttcattggtgaagttcgtgcaagagacgcaaaagaggagcaactttccctggaagaattgaggtggctcaagcgaaaactgaaagaacgcgggaaggaagtggacaacaattccatctgggctgaacgactaggcttgtatcagttcattgatgagaagcgaaaatccaagcgacaacgccgcaagaaggcgcagcagcggcgcagtcaaaagacaaataaatcgcaagtagtcgagttatttcctcaaaatgctgttcctgagaaccagcctgaagttcaggagtcagagactaaagaaagtacactccccactactgaccaacctcagcctgatattgtaaagtctaaagacacaccagcaagtcaaccgatcgcatccaatgtcgttgcgtacgattggaaccagcttttagaggacaactggtagtaaaggaggtaaataatggcgacatctaacgcagttccacaaccactagatgatgattcgcaatcagtaactgcacctcagccagatgcggcacctcagccagcaccgctccgcccgcttgctgaaccggaacgatcgcctgaagttcaggcagaagtcgagcgcattcgtagcagcgaagcatacaaggacatttctcgtgattcagccctgtttttctggctcagccttcagcgagattctcgatcgaacggctacgtctttggggctaattttgcagatttaaggaaggcttgccagttctacaggatgcaatacgtccagcgtcgggggactctctacaagattccgatgcctgttacctatgtggatgttgaacagtatggttctcctattgatctactcgttgctattcttgaatcgcttggtagcccctttgcaaaaatcggtttgctcagagatatgagatcgcgcacttttggtacgctcaactcttttggggtcaaacttcttataattggctatgcagaatgcttatcctacgaggcttataacgagcttctcaggttgacccggcagttaaaaatttcggtaattcttgcaggttcaatggaactaagggagatcttgggcaattttgtaaaccgtcgaagtaagcgttatggagagatttacaacaattttctggactttcacgaatacagagcttttgagaaaagtgatattgaaacgttgctcgaaagctgggagaaccaggtgttgagttcttgggatcagaaattagctctgaaagatattcctgatgttccggcttttctttatcaacgctgtgaagggcatgctgaaactctgtacgaaattctccgcaaaatagcaattttcaagctagataatccttctcatcaactgagcaaagctgatattgagaatatggtgtcgcgacgtacgataccaaaacgctcctaatagaggaggatataaatggacaacgaagcgtttgatctgccgcgctggtgccctgaaccctatgaaggagagagcattgccagttatctcgtgcggtttcgctctcaggaagtcgcccaaatttctacgcccagcagcttcagcaaggcgatcggcttggggattgcacttacacggtgggagaagtttcgcttcaatccttttcccagtgaggaggagatacagaagttttgtggtgtggtgggtttagagttagagcggtttaaggcgatgctgccaccggaaggggagcgaatgaagttggaaccgattcggttgtgtgcggcttgctatgcagaagccccttatcatcggttgaagtggcagtttcagtcaacggagggctgtagtaagcataagctacgtctgctctctaaatgccctggttgtgaaagaccttttacgattcctggtttggctgtggaagggaaatgtccgtgtgggatgttttataagaggatggcaaagagtcaaaagccttattagtaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtc

SEQ ID NO: 399 - DNA, 7392 bp, artificial sequence
  Synthetic
gatgtgctgcaaggcgattaagttgggtaacgccagggttttcccagtcacgacgttgtaaaacgacggccagtgaattggcccatgggcaacagtcagcaaaatcctgatttagctgttcatccctcggcaattcctatagaaggcttactaggagaaagcgatataactcttgagaagaatgtaattgccacacaactctcagaggaagcccaactcaagctagaggtaatccaaagtttactagaaccctgcgatcgcacaacctatggacaaaagttgcgggaagcagcagagaaactaggtgtatcgttacgaacggtacaaaggttggtgaaaaactgggaacacgatggcttagtcggactcactcaaacaggtagggctgataaaggaaaacatcgcattggtgagttttgggaaaaattcattaccaaaacctacaacgagggtaacaagggtagtaaacgtatgacccctaaacaagttgctctcagagtcgaggctaaagcccgtgagttaaaggactctaagccacccaattacaaaaccgtgttacgggtattagcgcccatattagaaaagcaagaaaaagccaagagtattcgtagccctggatggagaggaactacgctttcagttaaaacccgtgaagggaaagatttatcagttgattacagtaaccatgtttggcaatgtgaccatacccgcgtagatgtgttgctcgtggatcaacatggtgaattactaagtcgtccctggctaacaacagtaattgatacttactctcgttgcattatgggtatcaacttgggctttgatgcacctagttctggggtagtagcattagcgttacgccatgcaattctacccaaacagtacggtttcgagtacaaactgcattgtgagtggggaacctatggtaagccagaacatttttatactgatggcggtaaagactttcgctctaaccacttgagtcagattggagcgcaattaggatttgtctgccatttacgcgatcgcccttctgaaggtggagtagtagaacgtcctttcaaaacattgaatgaccaactattttcaacgcttcctgggtacaccggatctaatgtgcaggaacgcccaaaagatgcggaaaaagacgcaaggctcactctaagggaactagaacagctacttatacgctatatcgttgaccgttacaaccaaagtattgatgctcggatgggcgatcaaactcgctttgagcgttgggaagcaggattgcccacagtaccagtaccaataccagaacgagatttggacatctgtttaatgaagcagtcacggcgtactgtacaaagaggtggttgcttgcagttccagaatttgatgtatcgaggagaatatctggcaggttatgcaggggaaactgtcaacttgagatttgaccccagagacattacaacaattttggtttatcgccaggaaaacaatcaggaagtatttctcacccgcgctcacgctcaaggtttggagacagagcaactggcattagatgaggctgaggcagcaagtcgcagactccgtaacgcaggcaaaactatcagtaaccaatcattattgcaagaagttgttgaccgcgatgctcttgtcgcaaccaagaaaagccgtaaggagcgtcaaaaattggaacaggcggttttgcgatctgctggggttgacgaaagtaaaactgaatccttgtcctcccaagtagttgaaccagatgaagtggaatctacagaaacggttcactcccaatacgaggacatggaagtgtgggactatgaacaacttcgtgaagaatacgggttttaatagaggaggatataaatgacagaagctcaagcgatcgccaagcagttgggtggggtaaaaccagatgatgagtggttgcaagctgaaattgctcgtctcaagggtaagagtattgtgcctttacagcaggtaaaaactctccatgattggttggatggcaagcgtaaagcacggcaatcttgtcgagtcgttggggaatcacggactggcaagacggttgcctgtgatgcctataggtacaggcaaaagccacagcaagaagttgggcgacccccgattgtgcctgtagtttatattcagcctccgcaaaaatgcggctctaaggatttattcaaggagatgattgagtatcttaaatttcgagcaacaaagggaactgtttctgattttcgtgggagggcgatggaggtactcaaggggtgtggggtagaaatgctgattattgatgaagctgatcgcctcaaacctgagacgtttgctgaggtgcgagatatttatgacaagttaggaattgctgtggtattggtgggaacagaccgcttggaggcagtaatcaagcgagatgaacaagtctataaccgctttcgggcttgtcatcgcttcggcaagttatcggggaaagattttcaagatactgtgcaagcctgggaagatagagttttgaaactgcctgtttcttctaatttaactagcaaggatatgctgcggattctcacatcagcaactgaaggttacattggccgcctggatgagattctcagggaaacagcgattcgttctttatctaagggatttaagaagattgataaggctgttttacaggaagtggcgaaagagtacaagtgataaaggaggtaaataatgacaacaccagatgttaagccttggctttttattatagaaccctatccaggggaaagcctaagtcattttctaggtcggtttagacgtgctaaccatttatctcctgctgggttgggtggtttagctgggattggtgctgtagtggcacggtgggaaagatttcattttaaccctcgccctagtcaaaaagagttggaagcgatcgcatctgtagtagaagtggatgcccaaaggttagcccagatgttaccacctgctggagtgggaatgcagcatgagccaattcgcttgtgtggggcttgttatgctgaagcgccttgtcacagaattgagtggcagtataagtcggtgtggaagtgcgatcgccatcaactcaaaattttagcgaagtgtccaaattgtcaagcaccttttaaaatgcctgccctgtgggaagatgggtgttgtcatagatgtaggactctgtttgcggaaatggcaaagcaacagaagagttaataacctaggttaattaagtttaaacgagtattctatagtctcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggtcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcg

SEQ ID NO: 400 - DNA, 6630 bp, artificial sequence
  Synthetic
ctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggcttagacgaagaatttgagttcactgaggaattgacgcaagctccagatgttattgtgcttgacaagagtcattttgtggtagacccatcccaaattattctgcaaacatcggataagcataaactgagatttaatcttatcaagtggttcgctgaatcccccaacattactattaaatctcagagaaaacaggcagtcgtagatacccttggtgtttctactcggcaggtggagcgtctcctcaagcaatatcataatggtgagttatcagagacagcgggagtacaacgctcagataaggggaaacttcgcatcagccaatactgggaagattatattaaaacaacttatgaaaaaagtctgaaagataaacatccaatgttgccagcagctgtcgtgcgggaagtgaagcgacacgcgatcgttgacctcggactgaaaccaggagattatccccatccagccaccatctatagaaatttagctcctttaatcgagcaacacacgcggaagaaaaaagttagaaatccgggttcgggatcttggctgaccgttgtcacgcgagatggtcagctactgaaggctgactttagtaaccaaattatccaatgcgaccataccgagctggatattcatatagttgatagtcatggcagtttattgtctgaccgtccttggctaactactgttgtcgatacttattcaagttgcattcttggttttcatttatggatcaaacaaccaggttctacggaggtagctcttgccttgagacacgccattctacccaaaaattatccagaggactacaaacttggcaaagtttgggaaatatatggacctccttttcagtatttttttactgatggtggaaaagattttaattcaaagcatctaaaagccattggtaagaaattaggatttcagtgcgaactacgcaatcgcccgccccaaggtggaattgtagaacgtctttttaaaaccattaatactcaagttcttaaagagcttcccggttacacgggggcaaacgttcaagaacgcccgaaaaatgcagagaaagaagcctgtttaacaatacaggatttggataaaattctagccagcttcttttgtgatatttataaccacgaaccctatcccaaggagcctcgcaacacgagatttgaacgctggtttaaaggtatggggggaaaattacccgaacctttggacgagcgagaattggatatttgtttgatgaaagaagcacaacgagttgttcaagctcatggtagcatacagtttgaaaacctaatttatcgaggagaagctctgaaggcatatagaggtgaatacgtcaccctaagatacgatcccgaccatgtcctgactttatatgtctatagttgcgaagctgatgataatgcagaagagttcttgggctatgctcacgctataaacatggatactcatgacttgagtatagaagaattgaaaactctcaataaagaacgaagtaaagctcgtagcgatcattacaactatgatgctttattagcattgggtaaacgcaaagaacttgtagaagaaagaaaacaagacaagaaagcaaaaaggcaatcagagcaaaaacgtctccgcactgcttccaagaaaaactcaaatgttattgaactacgcaaaagtagagcttcgagttcttcaagtaaagatgaccgacaggaaattttaccagagagagtttctagggacgaactaaagccggagaaaacagaactgaaatatgaggaaaatctgttagcacagaccgatactcaaaaacaggagagacataagttagttgtctctgaccgtaaaaaaaatttaaagaacatttggtgataaaggaggtaaataatggccatatctcaactggcaacccaaccatttgtcgaagtcttacctccagagttagatagcaaagctcaaattgctaaaactattgatattgaggagcttttcagaattaattttatcacaaccgatcggtcatcagaatgtttcagatggttagatgagctgcgtatcctgaaacaatgcggtcggatcattggaccaagaaatgtaggcaaaagccgagcagtgcttcactatcgtaatgaggataaaaaacgagtttcttatgtaaaggcttggtcggcatcgagttctaaacgtctattttcacaaatcttaaaggatattaaccatgctgcatcaacaggtaaacgacaggatttacgtccaagattagctggtagtcttgaactatttggattagaattggtcattgttgataatgctgaaaatcttcaaaaagaggcgctcttagatttaaagcaactttttgaagaatgccatgttcctattgtcttagttggaggtaaggagttagatgatattttagaagattttgatttgttgactaactttccaacgttatatgagtttgaacgattggaacatgatgattttataaaaacattaaagacaatcgaattggatattttatctcttccagaagcgtctaagttaagtgagggtaacatatttgcaattttagctgagagtacaggtgggaaaataggaattttagtcaagatactaactaaagcagttttacattctcttaaaaagggatttggtaaagttgatgaaagcattttagaaaaaatcgcaagtcgttatggaacaaaatacgttcccattgaaaacaaaaatagaaacgattaatagaggaggatataaatgattgaagatgatgaaattcgtctaaggttgggctatgttgaaccacacccaggtgaaagcatcagtcattatttgggacggcttcgtcgatttaaggctaacagccttccttcaggatatgctctaggaaaaattgcgggtcttgggtctgttctgactcgatgggaaaagttgtacttcaacccatttcccactcaacaagaactagaggcattagcacaagtgattcaagtggaggttgagaaattaagagagatgctacccactaaaggtgtcacaatgatgcctcgacccattcgattatgtgcggcttgctatgcagagtcaccttatcaccggatcgagtggcagtttaaggacaaaatgaagtgcgatcgccatcagttgcgcttattaacaaaatgcacaaactgtcagacaccattccccattcctgctgattgggaaaaaggagaatgctcgcattgttttttgtcttttgctaagatggtgaagtgtcaaaagcgtcgttagtaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgacaagctgacgaccgggtctccgcaagtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcggtcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggcatgctagcgcagaaacgtcctagaagatgccaggaggatacttagcagagagacaataaggccggagcgaagccgtttttccataggctccgcccccctgacgaacatcacgaaatctgacgctcaaatcagtggtggcgaaacccgacaggactataaagataccaggcgtttccccctgatggctccctcttgcgctctcctgttcccgtcctgcggcgtccgtgttgtggtggaggctttacccaaatcaccacgtcccgttccgtgtagacagttcgctccaagctgggctgtgtgcaagaaccccccgttcagcccgactgctgcgccttatccggtaactatcatcttgagtccaacccggaaagacacgacaaaacgccactggcagcagccattggtaactgagaattagtggatttagatatcgagagtcttgaagtggtggcctaacagaggctacactgaaaggacagtatttggtatctgcgctccactaaagccagttaccaggttaagcagttccccaactgacttaaccttcgatcaaaccgcctccccaggcggttttttcgtttacagagcaggagattacgacgatcgtaaaaggatctcaagaagatcctttacggattcccgacaccatcactctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccacc

SEQ ID NO: 401 - DNA, 5643 bp, artificial sequence
  Synthetic
ggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtttcaacacccctcccgaagtggggcgggttgaaagcgagacctcaattggtctccgtttcaacacccctcccgaagtggggcgggttgaaagggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgagccaaatcactattcagtgtcgtcttgtagcttctgagccatcacgtcatcaactatggaagttgatggtagatttaaatacgccactgattaatgaattattggttcaggtagcccaacaccctgaatttgaaacttggcgacaaaagggcaaacacccagccaaaattgtcaaagaattatgcgagcctttgagaactgatcctcgcttcatcggtcaacctggacgtttttacacaagtgcgatcgccacagtaaattacatctacaaatcttggtttgcattgatgaagcgatcgcaatcccaactagaaggtaaaatgcgctggtgggaaatgcttaaaagcgatgccgaattagtagaagttagtggagttactttagagagccttcgtactaaagctgctgaaatactgtctcaatttgctccccagccagatacagttgaagcacaaccagcgaaaggaaagaaacgtaagaaaaccaaaaaatcagatggcgattgcgcggagcgcacgctacgcgaacgtagtatttctgattatttgtttgaagcctaccgcgacacagaagaaatcttgacacgttgtgcaattaactatttactgaaaaatggttgcaaaatcagcaataaagaggaaaatgctgaaaaattcgctaaacgccgccgcaaactggagattcaaattgaacgcctaagagaaaaactagaggcacgaatccccaaaggtcgagacttaacggatgccaaatggttagaaactcttttgctggccactcttaatgttcctgaaaatgaagcggaggcgaaatcttggcaagacagtctgctaaaaaaatctatcacagtacctttcccagtcgcttatgaaaccaacgaggacatgacttggtttaaaaacgaaaggggacgtatctgtgtaaaatttagcggactgagtgagcatacttttcaagtctattgcgattctcgccaactccaatggtttcaacgttttttagaggaccagcaaatcaaacggaacagtaaaaaccaacactctagcagcctattcactctccgtagtggacgtattgcatggcaagagggggaaggtaaaagtgaaccttggaaagtcaaccgcttaatcctttactgttctgtagatactcgcctgtggacggctgaaggaacaaacctagtccgagaagaaaaagcagaagaaattgctaaagctatcgcccaaacaaaagccaaaggcaaactcaacgataaacaacaagctcatataaaacggaaaaactcttctctagccagaattaataacctctttccccgccccagcaagcccttatataaaggtcaatctcatattcttgttggtgttagccttggtttagagaaacctacaacactagcagtggttgatggctctataggtaaagtgcttacttaccgcaacattaaacaacttctgggcgataattacagacttttaaatagacaacgacaacaaaaacacaccttatcccatcaacgccaagtagctcaaatcctggcttcaccgaatcaacttggggaatcagagttgggacagtatgtagacagattactagctaaagaaattgtagcgatcacccaaacatataaagctggctctattgtcctgcctaaattgggcgatatgcgagaacaggtgcaaagtgagattcaagctaaagccgaacagaaatcagacttaatagaagttcaacaaaaatactccaaacagtaccgagttagcgtccatcagtggagctatggtcgattgattgcaagtattcgctcgtcagcagctaaagttggaattgtgattgaggaatcgaaacaaccgattcgaggtagtccacaggagaaagcgagagaattagcgatcgctgcttataattctcgccgacgtacctgataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtc

SEQ ID NO: 402 - DNA, 5586 bp, artificial sequence
  Synthetic
acctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggttgaaataagacaataccttctatagggattgaaagcgagacctcaattggtctccgttgaaataagacaataccttctatagggattgaaagggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatggttcaggtaactattcaatctcgtttaatcgcttctgctgatactcgtcaatctctctggttgttgatgagcaagaaaaatactcctttgatcaatgaaatccttacccgaattaaacatcatcccgattttcctcaatggcgagagaaaggcagactgccgaaaaactttattgctcaacaaattcaagagctaaaaaatgattctcgttttcaaggacaaccatctcggttttatgcttctgtcggtaaaatcatcgactacatatacaaatcttggttcaaagtgcaaaagagttacaaaatccaattagaaggtaatagccgttggttagaaatgttgaaacccgatagtttattaatagaatcctttgatggttcaatggaagcactgcaaaatcaggctcaacagattctcgataacattgaaacgacttctactcaagaaggtattgttgattatttatttcaaaaatatgagaaaatagaaaattgtcgaatgaaggatgcgatcgtttatctgatcaaaaatggtagtcgtattcctaagaacaacattgaaacaaccaagaaatataaacgtatcaaacgcaaattagaaatcaaaattcgtaaattgaaaagacaagtggaaatgtctattccttctggcagagatttagagggagaaaaatggttgcacactctcatccttgcttctaacacgatgccagtagatcaaagtgagagtgatagttggttttcagcactgaaacgaaattctccgtcaattccctatcctattgtttatgaaagcaatgaggatttaacatggtgtttgaataaccaaaaccgtatttgtattaaatttagtggtttgagtgaccatctttttcaaatctattgtgattctcgtcaactggcctattttcggcgtttttatgaggatcaggaattgaaaaaagccagtaaagatcagttttcgagtgctttatttactctgcgatcggctatgatcatttggaaagaagatgatggaaaaggagagtcgtgggataaacataaactctatttacattgtacttttgatacagattattggactgtggaaggtacacaagtcattgctcaaaaaaagcaggaggaagtgctaaatctcattgataggatgaaggaaaagacggatttaacagatactcaaaaggcatttattcaacggaaacaaacgactcttgcccgacttaataacatttttcctcgccctagtaagcctatttatcaaggtaatccgaatctttttctcggtgtagcaatgggtttacaagaaccagttacgatcgcacttgtggatgtcagcacaaataaagtgattctctatcgtaatatcaagcaattattgggagataattaccatctactccgtagacgtcgtaatgagaaacagaaattgaatcaccaaaaccataaagcaaggaaaagagctaattttcaacaaaagggggaatctaatctgggtgaatacctcgatcgcctcattgccaaatccattcttcaaatcgctaaagagtaccaagtatcaactattatcgttcctcgattaaatcagatgcgatcgattacggaggcagaaatacaagcaagggcggaggagagaataccagaatataaggaggggcaacgaaaatatgcacaggattatcgtgtacaggtgcatcaatggagttatggcagattgattgacaatatcaaagcgatttcttctaaattgggtattgtcgtagaggaaggcaaacaacccaaacaaggaacatttaccgataaggcatcacagttagcattgagtacccagaaaaataatcgccaaaataatcccaaaaagacaaattcttaataacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaact

SEQ ID NO: 403 - DNA, 6051 bp, artificial sequence
  Synthetic
ctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggttgcattcgccctcccgatgttgggtgggttgaaagcgagacctcaattggtctccgttgcattcgccctcccgatgttgggtgggttgaaagggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgcagttgagagtaatttgttgctgtctaagtgccgatgaagcgacccgccagttcttttgggaggcaatggttaaatatacgcttctggtcaaccgcctgctagaacaagttgggcagttgtctgagtttaagcagtggcaagaaaagggcagtatctcgaaagagcctgtcaagcagttatgtgatgcccttaaaaaacaccatgcagagtttcaggggttgccacaccgcttctacatctcagccaaacttatggtgacttataccttcgagtcttggctggcgttacaacaacgtcgccggcgtaaaattgatggcaaacgacgctggttaaaccgagttgaagatgatattgaacttgcaaaagtgacggactttagcccagaaatgattcagaatcgggctaggaaaatcctagcagagatacatccatctaaccctgttgaacctgaacctgagacatcttcagacaatgaaataaatgaaggagagaactgccaggaagaggaagagatgaatcaacccaaatctcttctttcctgcttgtttgatttgtacgacagtacggaagatgcgcttactctccgggcgatcgttcatttgctcaaaaataatggtgaagtgaatgaggaggacgaagatcctaaaaaacttgaactgcgtttagccgccaagcgcgaggaaattcagaggttagagaaacaactgcaaggacgtttaccaaaaggacgcgatccaacgggtgaaactaccactcgttttttagaagaggctattaagctacctgaacacccaaccgcctatccaccccggtttcttctcaacgccttttattgctacgccttactgccaatgccgtacatccagtacggagtctatctcctcaatgccattttggatgaagccaggatcgttgagtctgacttcatcacctggagagatacgatcgcagaacatctggtgaacgcggctaaacgacccaactccttgccctatccgcttatctttggcagtactagcgatctggtttgggaatcagaatcgaaaagaaaaggtcccaacgctcctgatacagagggagcattggagcaatcaggagccaaatcatcaagaaagcgtccatctaagcgaaagcggacaaggctcaaaacacaatcagatgagagaatcaccgtacgctttcatggcatgagccagtatcgcttcaaaatctactgcgatcgacgccagcttccgatatttcgccagtttctgactgactactgtacgcataaggcacttgacgaagagaataagttttctatgggcttgtttgccctccgttcagccagcttaatctggaaaaaagacaaacaacgtcctcacaaacgtaactcttcggagccagttgaaccgttgtcgccttggcaaactcatcgactttatttgcactgttccatcgattctcgcttgttgaccgctgaaggaacggaacaagttcgcttccagaagatcctccagactaaacggaaattagaaggggcaaagaataaagaacaagaaattctcagacaaaaatctgaacgtcaacataccgagtcggaacaagacttagacgataaactgaagaaacagcggcagaatgttgcacggaatcaaaccagtttaaattgcctgtataatcctacaccgccacgccctagtcgagttcgctatcaaggaaatcctaacattgctataggggtcagcttttgtcgtcaacaacttgttggagtgggagtaattgatctgcaaacgcaacaagtgcaggaatactacagtatccgcagattactgatcaatcgtaaagttactcaagtaaaacgtggtcgcagcgttcttcagttaaagctaaaaaaatatcggttagtcaaccaattatgtatgtggaagaagaagaacattactcaacgaacccaacaacaaaagcaaggactgtgcattcaaaacaccactgaatctaatctaagacagtatctggaacgattagttgcagaccgaattgtggaagtggcactgaagcaccaagccggaagtattgtcacaccgcaactgggagagatccgcgagagtattgaaagtgccgttcaagcaatagccaagcaactcttcgagaatcaccgagaggcgcaacaggcgtacgcgaagcagtttcgcatggattttcatcggtggagttacggtcgattaaccgactgtattcatagccgtgctcgtcaggagggcattctagttcaagctggacgacaacctgtcgagggcaatcttgttggtaaagccctcacaatcgccttatcagggcgaaatttggtctagtaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgct

SEQ ID NO: 404 - DNA, 5652 bp, artificial sequence
  Synthetic
ggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtttcaacaaccatcccggctaggggtgggttgaaagcgagacctcaattggtctccgtttcaacaaccatcccggctaggggtgggttgaaagggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgagcacaatcacgattcaatgccgcctagttgcagaagaagcgaccctgcgctacttttgggaacttatggctgagaagaatacgccactcattaatgaattgttggagcagttaggacaacatccagattttgatacttgggtacaagcaggcaagatgcctgaaaagacagttgagaacttgtgcaagtccctagaagatcgagaaccttttgcaaatcagcccggtcgttttcgtacttcggcagttgctctggtaaagtacatttacaaatcctggtttgcgttacaaaaacgtcgggcggacagactagaaggtaaagagcgctggttaaagatgctcaaaagtgatgtggaactggaacgagaaagcaactgtagtttggatattattcgagctaaagctggggaaattcttgctaaagttactgaggggtgcgctccgagcaatcaaacatcctctaagagaaaaaagaagaaaactaaaaaaagccaagcgacaaaagatctccctacgcttttcgagattatattaaaggcttacgaacaagctgaagaaagcctgacacgagctgcccttgcttatctccttaaaaatgactgtgaagtcagtgaagttgatgaagattcagagaaatttaaaaagcgtcggcgtaaaaaggaaatagaaattgaacgtttaagaaatcaactgaaaagtcggatacctaaaggtcgcgatttaaccggagataagtggttgaaaacgctagaagaagccacccgaaatgttcctgaaaatgaggatgaggcaaaggcttggcaagcccaactcttgagagaagctagttctgttccttttcctgtagcttatgaaactagtgaagatatgacttggtttaccaacgagcaaggtcgaatctttgtttactttaatggttcagccaaacataaatttcaagtttattgcgatcgccgtcaacttcattggtttcaacgttttgtagaggactttcaaatcaagaaaaatggtgataaaaaaggtagcgaaaaggagtaccctgctgggttattgacgctttgttccactcgtctgagatggaaagaaagcgcggaaaaaggagatccttggaatgttcatcgcctaattctttcttgcactatcgatacacgcttatggacacttgaaggaacggaacaggtgcgagctgaaaagatcgctcaggttgaaaaaactattagcaagcgggagcaagaagttaatctgagtaagactcaacttgagcgtttacaagccaagcacagtgagagggagagattgaacaacatttttcccaaccgccctagcaagcccagttaccggggtaaatctcatattgcgatcggtgtaagtttcagtttggaaaacccagccactgttgccgtcgtagatgttgcaaccaagaaagtccttacttaccgcagtttcaaacaattactcggagataactacaaccttgcaaaccggctgcggcaacaaaagcaacgtctttctcacgaacgtcacaaagctcagaaacaaggcgcaccaaattcatttggagactcagagttagggcagtatgtagacagattgcttgcaaaatcgattgtcgcgatcgcaaaaacttatcaagctagtagtattgtcttgcctaaacttcgctatatgagggaaatcatacataatgaagttcaagctaaagccgaaaaaaagattccaggatataaagaaggtcaaaaacaatatgccaaacagtatcggataagcgttcatcaatggagttataatagattatcacagattcttgaaagccaagctacaaaagctggaatttctattgaacgtggatcgcaagtaatccaaggtagctcccaagaacaagcacgagatttagctttatttgcctataacgaacgccaacttagtctgggttagtaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactacctt

SEQ ID NO: 405 - DNA, 3797 bp, artificial sequence
  Synthetic
gctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcagattgttgtcgattgccaaattctttgtctgcgttgacaaattgttgtccgtattgccaagttgttgtccgcgttgccaaattacttagtcatcaaggtgtattggcattagaagctgttattataatagctttgatttattggtactgtttcggtcagggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagaatttacataaatgttcaataaaaacgtagttgtattgtactacttggaggacatttattttgtcaatttctgtaaaaatcttccctcaagtcccttttcaagcaaggacagatatttcgtcaacttttcaaaagaggacagctattttggcaataagtttctgggtattttgagcctaaaataacaaaacccttgcttggcaagggttttgaggataatattttgaatgacattaacttgtcaagtggtcatataatttggcaatcgacaattgtggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgc

SEQ ID NO: 406 - DNA, 3810 bp, artificial sequence
  Synthetic
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcagagagctgtacagtaacaaattatttgtcatcggtaacagattaatgtcgtcttaacaaattaaatgacgtgatcacaaattaatgtcgccaattcaatgactaggacgtggagggactcgctttcaattctcaaagagaattcttccttgctcggaagtgattggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagatagctgtttaataaaatcataatggttttatactaatcttaggacatctaatttgttaatgacaacccctaaaacaaaaaatcgccttttagaaagacgacatttaatttgttatttttctggaagatgacacttaatttgttaatcccatttgaggtgcgatcgctccttgttttaggggaagaattagttataattattgatatgcaaagatttgaagagtcttatttttagataacactaatttgttatcacgtcatttaatttgttactgtacaagagcggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 407 - DNA, 3810 bp, artificial sequence
  Synthetic
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcagttacttgtccattaaataattaatcgtcagttttaaagaattaatttcacttttttctgagaaagcctgacaaatcaagcttttaggggcttgaaacagaatatgaggctcactttgaacttgaaacttcagttttaaagaattaatttcaaaaaacttggttttttttcctcggtactcaatgaggtattgctaaataacgatatattttcacctgtatcggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagaagggttctttcaggtaggctgaaaaaagggaagtagttcaatttaaagaatatagtgtcacctaggaattagtgaagtagtttgatttagaagcctgaagagaataattcagcaaaaaataggctgtaacctctatccagtaaaggattcagccatttttgaggtaagtgtagaaagtgaaattatttctttaaattggaaattaattatttaatggacattactggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 408 - DNA, 3809 bp, artificial sequence
  Synthetic
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcagttttttgtacagtgactaattatttgtcgtcggtgacagattaatgtcgttgggactaattaactgtcgtcgggacgaattgatgtcgtttaggtgccagtgacagattaatgtcatttatttacagagactatagcgataatgtcaacgtagcgctctctttcaaccctccctaataaaaattggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagatttgtcattatgaaaatacacaaaagcttttttatctctgatgaagcgacagctaatttgtcactattacccaaaatgacagctaatctgtcactgtcaagatgttatcctaatactactaaaacgctgtaacctataccgagcaagattttaatggatgacattaatttgtctcgacgacatataattagtcactgtacatttttgtacaatgacaaataattagttaatgtacaataatttttgcatacttaaaaacagggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 409 - DNA, 3910 bp, Artificial Sequence
  Synthetic
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcagcaaagactacctacttaaatgaaccgcaaatgtacattcgcaaattaaatgtcgtaattcgcaaatttgtgtcgtttttcgcaaattaatgtcgtttagaatagtttgtctcatcaattcaattataggaacttttcgcaaattaatgtcgtcctgtttctccatttagtgtcgattaacaaattaatgtcgctgttaacgaattaatgtcgtcgaattagttccaactaacgttaacaaattaatgtcgtctaacataatgtcttgctaggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagaaaaaccactgattaacactttaggtactaaagtaccactaatgtggcaaaaatgcgacatctaatttgcgaaacaggcaaatcttaataaacgacatttaatttgcgaaaataggatttgcgacatctaatttgcgaaacaggcaaattactcagttttatggataaatagcttgtaagtcctacgcaataaagatctcagctattagaagtaattgcgacactaatttgcgaattgcgacatataatttgcgaatgtacaccaaccccaagcattggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 410 - DNA, 837 bp, Anabaena variabilis
atgacttcaaaacaggctcaagctgttgcccaacaattgggagatattccggtaaatgacgaaaaaatacaagcggaaattcaacgattgaaccggaagagttttattcccttggaacaagtacaaatgcttcatgattggttagatggaaagcgacaatcacggcagtctggtcgagtggtgggggagtcaagaacaggcaaaactatgggttgtgatgcctacagattacgccataaaccaaagcaagaaccaggacgacctccaactgttcctgttgcttatattcaaatcccgcaagaatgcggtgcaaaggaattgtttggagtcctccttgaacatttgaagtatcaaatgacaaagggaacagtagccgaaatcagggacagaacgctacgagttcttaaggggtgtggagtggaaatgcttattattgatgaggctgaccgcttgaaacccaaaacttttgctgaggtgccggacatttttgacaaattagaaatagcagtgattttggtaggaactgaccgcttagatgcagtaattaagcgggacgaacaagtttacaaccgttttcgggcttgtcatcgatttggtaagttttctggggatgaatttaagaagatagtagacatttgggaaaagaaggttttgcagttgccagttgcttccaatctttccagtaagactatgctgaagactttaggtgagacaacggggggttatattggtttgctcgacatgattctgagagaatctgctatccgggcattgaagaaaggattacggaaggtggatttggcaaccctgaaggaagtgacagaagagtacaaataa

SEQ ID NO: 411 - DNA, 504 bp, Anabaena variabilis
atggaagttccacagattcaaccttggctgtttcaaatagaaccgttagagggagaaagtttgagtcactttttaggacgttttcgacgggcaaatgatttaacacctactggtttaggtaaagctgctggacttggaggtgcgatcgctcgttgggaaaagtttcgatttaatcccccaccgtctcgccagcagttggaggctttggctaatgttgtcggggttgatgccgataggttagcgcaaatgttaccatctgctggggtggggatgaaaatggagccaattcggttatgtgctgcttgttatgccgagtcgccatgtcacaagattgaatggcaatttaaggtaacgcgagggtgcgcgaggcacaaaataactttattgtcagaatgtcctaactgcaaggcaagatttaaggttccagcattatgggtggatggttggtgtaatcgttgctttttacggtttgaggagatggctaagtatcagaaagggttgtag

SEQ ID NO: 412 - DNA, 1665 bp, Cyanobacterium aponinum
atgaccatcgataatcaattttctgattctccagaattgatctctcaactttctcccgaagaccaaaaaatcgctgatgttattgaaaatttacttcaaccttgtgacaagaaaacttatggaaaaaagttaaaacaagcatcagatcagttgaagaagtcggttagaactattcaaagatacgttaagcagtgggaagaaaatggtttagtcggtattcttcaaaataatcgagccgataaaggctcttatcgtattgacccccgcttacaggatttcattcttaaaacctatcgtgaaggaaacaaaggtagtaaacgaatgacgcctaaacaggtttatttacgagcagttgtccaagcagaaaattgggggatcaaacctccctctcacatgactatttatcggattttgaatcctattattgcggaaaaagaaaataagaaaaggattagaagttctgggtggagaggttctcagttagttctttctactcgctcaggtacagaaatcgatgtacagtatagtaaccatgtttggcaatgtgatcatactcgtgcagatattcttttggtagatcaatttggtgaattattgggcagaccttggataacgatagtggtagatacttattctcgctgtattatgggtattaatcttggttttgatgctcccagttcccaagtggtcactcttgctttacgtcatgccattttgcctaagagttacagttctgattatgaactacatgaggaatggggaacttatggtaaaccagagtacttttacactgatgggggtaaggattttcgttctaatcatcttcaacaaattagcttacaactgggttttacttgtcatctaaggagtcgccccagtgaagggggagtagtagagcgtctttttaaaactttgaacacggaggttttttctactctaccaggatatacaggagcaaatgtacaagaacgtccagaagatgcagaaaaagaagcctgtctcactcttaaggagctagaaatacttatagttcgctatatcgttgataactacaaccaacgtattgatgctcgtatgggagagcaaactcgctttcagcgttgggagtcaggattgctttctactcctcatatcatacctgaacgtgaattagatatttgtttgatgaaacagtcacgcagaaaagttcaaaagggtggtcatcttcaatttgaaaacttgatctataagggtcagtatttagcaggttatgaaggagagacagttattcttcgttatgatcctagggatattacgggtattttgatttatcgtgttgagaataataaagaaatttttcttactcgtgcttatgccacggatttagaaggggactgtttatccttaacggatgcgaaatctagtgttaagagaattagagagaagtctaaaaatgttcataataagtcaattttaatggaaattcaacaacgtcatttattttcagaaaagaaaaccaagaagcaaattcagcaagaagaacaaaaacaaattaaaccaaatacttctctatctatcttcaaaccagaaactgagatggatacgcaggttgaatcatcacaggagctatcagaggaagacttggatattgaaatgattgactacggtaatttacaacaatattaa

SEQ ID NO: 413 - DNA, 834 bp, Cyanobacterium aponinum
atggaagcgaaagaaattgctcaacaattgggagaggttgaacagccaaatcagtctttgcagaatgaactggatcgactatcaaaaaaacaatttctgtttttagatcaggtaaaaatctatcaccaatggttgaatgaaagattattcatgaaacattgttgccgagttgtgggggattcacacacgggcaaaacctcgtcttctcaagcctactgtctaagatataaatctactcaagagtcggggaaaaatcctatttttcccgtgttatatgtttctgtccccgaaaatgcaacttcaaaagtcttttttgagacatcaattaagagtttcggttatcgaatcagtaagggtacgatttccgatttaagagaacgaatgctgacattactgtccagatgtcaggttaaaatgatgattattgatgaggctgaccgatgtaaacctgaaactctgagttatatacgagatatattcgatcatctcaatatttgtattgttttggtgggtacagatcgacttaatacggtacttaaaagggatgagcaagtctataatcgttttttaccgtgttatcgctatggtcttttagataaagaatcccttattaaaacaataaaaatttgggaaattaaaattttaaaacttcctgtagcatctaatttaagtcagggcaaaaagtttaatattatttattctacttctaaaggatgtttaggaacaatggataaattgttgagaacatctgcttctatggctttaattagaggtttatcgaagattgaattgaatatattggaagaagcagcgcacttgttcaaagataaatga

SEQ ID NO: 414 - DNA, 492 bp, Cyanobacterium aponinum
atgattacaaatagttttgattcttggatattaatgcttgatccttatcaaggagaaagcatcagtcattttctaggaagatttagaagggagaatagtcttaccgttaataatttagggaaagcaaccgaactttatggagcgatcgcccgttgggaaaagtttcgttttaatcctcctccttcctctgaacagttgaaaaagttaagtgcgatcgtacaagtagaagtagcaaccttacaaacaatgtttccttccgccccgatgaaaatgactcccattcgcctttgttcggcttgttatggagaaaagccctatcataagatggaatggcagtataaggagatttacaagtgcgatcgacatcaactgaaacttttatcagaatgtcctaactgtggggcaagattcaagtttcctagtctatgggtggatggttggtgtcacagatgttttactccttttgcagagatgaaacaacaaaaagattag

SEQ ID NO: 415 - DNA, 1908 bp, Filamentous cyanobacterium
atgtctacagacgctacctcggcaacttgctccccttctcaggattcgggtttggaacaggggcagcaggggcaaccccccatgcttctcaatgaggtttcgccggaggtgcaacagaaaattgatttaattgatgctatctttcaaactcctgacaagaaagctcgaagggaagcgattctacatgccgcaaagacattgggcaaaacgactcgaaccatccggctcatgatggaaaaggtcaagaatgacggagttgccacgctggcagtcggtcgtaaggatgaaggacagttccgcatctctgagcagtggtctaactttattaaagtgatttatgaatggggacagcgagacggttcgcggatcaatatcaatggagtatatacccatttggtcgctcttgcctctcaaggagaagcattgcgggataaaaagtacgccgatcgctttaagggttatccccaggtacttgaggatctagttgcaggaaaacatccctctcatgtcactgtttataaagttgttaatttttatcttgagcgaaaaaacaaaaaggttcgccatccgggttcacctgccgaaggacaagttatccaaaccacggaagggatcatagagctaactcacagtaatcaggtttggcaatgtgaccacactaagcttgatattttgctggtggatggtgatggggaagtaattttacaatgggatgaccaaaagcaagagattgttggtcgcccttatctaacattgatcatggatagttattccggctgtgtcgcagggtttcacctgggctttgaggcagcaggttcgcatgaagtgggtttagctttgcgccatgcgatgttacccaaacagtatggctccgagtacaaacttaaggcggagtggaatgtttttggcgtgccagagtattggctgaccgatcgggcgaaggaattcaagtccaatcatttgaagcaagtctcaatgcaagtaggcttcaagcgtagattgcgggcttttccatccgcagggggactcattgaatccattttcgacaagattaataaagaagtcttgtcccactttggaggctacacaggctcgaacattacaaaacgccctaaagaagcggaaaagcatgcatgtctgacgttggatgagctagagaagagactggtgatatactttgttgatcattacaacggacatgattacccaaaggtagccaatcaaaagcgatcgaaccggtggaaggcaaacctactgacagagccagaggtgctggatgaacgtgagcttgacatctgcctgatgaaagttgcccatcgcaaagttgaaaagtacggttgcattcggtttgagggacttgtgtatcagggagactgtctcgtagagtatgagggggatgaggtgtctctgaggtacgatgagcgcaatattcttgcgcttttggcttacgaacgacctcagcgcgatcgaccaggcaagttcattggtgaagttcgtgcaagagacgcaaaagaggagcaactttccctggaagaattgaggtggctcaagcgaaaactgaaagaacgcgggaaggaagtggacaacaattccatctgggctgaacgactaggcttgtatcagttcattgatgagaagcgaaaatccaagcgacaacgccgcaagaaggcgcagcagcggcgcagtcaaaagacaaataaatcgcaagtagtcgagttatttcctcaaaatgctgttcctgagaaccagcctgaagttcaggagtcagagactaaagaaagtacactccccactactgaccaacctcagcctgatattgtaaagtctaaagacacaccagcaagtcaaccgatcgcatccaatgtcgttgcgtacgattggaaccagcttttagaggacaactggtag

SEQ ID NO: 416 - DNA, 951 bp, Filamentous cyanobacterium
atggcgacatctaacgcagttccacaaccactagatgatgattcgcaatcagtaactgcacctcagccagatgcggcacctcagccagcaccgctccgcccgcttgctgaaccggaacgatcgcctgaagttcaggcagaagtcgagcgcattcgtagcagcgaagcatacaaggacatttctcgtgattcagccctgtttttctggctcagtcttcagcgagattctcgatcgaacggctacgtctttggggctaattttgcagatttaaggaaagcttgccagttctacaggatgcaatacgtccagcgacgggggactctctacaagattccgatgcctgttacctatgtggatgttgaacagtatggttctcctattgatctactcgttgctattcttgaatcgcttggtagcccctttgcaaaaatcggtttgctcagagatatgagatcgcgcacttttggtacgctcaactcttttggggtcaagcttcttataattggctatgcagaatgcttatcctacgaagcttataacgagcttctcaggttgacccggcagttaaaaatttcggtaattcttgcaggttcaatggaactaagggagatcttgggcaattttgtaaaccgtcgaagtaagcgttatggagagatttacaacaattttctggactttcacgaatacagagcttttgagaaaagtgatattgaaacgttgctcgaaagctgggagaaccaggtgttgagttcttgggatcagaaattagctctgaaagatattcctgatgttccggcttttctttatcaacgctgtgaagggcatgctgaaactctgtacgaaattctccgcaaaatagcaattttcaagctagataatccttctcatcaactgagcaaagctgatattgagaatatggtgtcgcgaaggacgataccaaaacgctcctaa

SEQ ID NO: 417 - DNA, 510 bp, Filamentous cyanobacterium
atggacaacgaagcgtttgatctgccgcgctggtgccctgaaccctatgaaggagagagcattgccagttatctcgtgcggtttcgctctcaggaagtcgcccaaatttctacgcccagcagcttcagcaaggcgatcggcttggggattgcacttacacggtgggagaagtttcgcttcaatccttttcccagtgaggaggagatacagaagttttgtggtgtggtgggtttagagttagagcggtttaaggcgatgctgccaccggaaggggagcgaatgaagttggaaccgattcggttgtgtgcggcttgctatgcagaagccccttatcatcggttgaagtggcagtttcagtcaacggagggctgtagtaagcataagctacgtcttctctctaaatgccctggttgtgaaagaccttttacgattcctggtttggctgtggaagggaaatgtccgtgtgggatgttttataagaggatggcaaagagtcaaaagccttattag

SEQ ID NO: 418 - DNA, 1755 bp, Nostoc punctiforme
atgaacagtcagcaaaatcctgatttagctgttcatccctcggcaattcctatagaaggcttactaggagaaagcgatataactcttgagaagaatgtaattgccacacaactctcagaggaagcccaactcaagctagaggtaatccaaagtttactagaaccctgcgatcgcacaacctatggacaaaagttgcgggaagcagcagagaaactaggtgtatcgttacgaacggtacaaaggttggtgaaaaactgggaacacgatggcttagtcggactcactcaaacaggtagggctgataaaggaaaacatcgcattggtgagttttgggaaaaattcattaccaaaacctacaacgagggtaacaagggtagtaaacgtatgacccctaaacaagttgctctcagagtcgaggctaaagcccgtgagttaaaggactctaagccacccaattacaaaaccgtgttacgggtattagcgcccatattagaaaagcaagaaaaagccaagagtattcgtagccctggatggagaggaactacgctttcagttaaaacccgtgaagggaaagatttatcagttgattacagtaaccatgtttggcaatgtgaccatacccgcgtagatgtgttgctcgtggatcaacatggtgaattactaagtcgtccctggctaacaacagtaattgatacttactctcgttgcattatgggtatcaacttgggctttgatgcacctagttctggggtagtagcattagcgttacgccatgcaattctacccaaacagtacggtttcgagtacaaactgcattgtgagtggggaacctatggtaagccagaacatttttatactgatggcggtaaagactttcgctctaaccacttgagtcagattggagcgcaattaggatttgtctgccatttacgcgatcgcccttctgaaggtggagtagtagaacgtcctttcaaaacattgaatgaccaactattttcaacgcttcctgggtacaccggatctaatgtgcaggaacgcccaaaagatgcggaaaaagacgcaaggctcactctaagggaactagaacagctacttatacgctatatcgttgaccgttacaaccaaagtattgatgctcggatgggcgatcaaactcgctttgagcgttgggaagcaggattgcccacagtaccagtaccaataccagaacgagatttggatatctgtttaatgaagcagtcacggcgtactgtacaaagaggtggttgcttgcagttccagaatttgatgtatcgaggagaatatctggcaggttatgcaggggaaactgtcaacttaagatttgaccccagagacattacaacaattttggtttatcgccaggaaaacaatcaggaagtatttctcacccgcgctcacgctcaaggtttggagacagagcaactggcattagatgaggctgaggcagcaagtcgcagactccgtaacgcaggcaaaactatcagtaaccaatcattattgcaagaagttgttgaccgcgatgctcttgtcgcaaccaagaaaagccgtaaggagcgtcaaaaattggaacaggcggttttgcgatctgctggggttgacgaaagtaaaactgaatccttgtcttcccaagtagttgaaccagatgaagtggaatctacagaaacggttcactcccaatacgaagacatggaagtgtgggactatgaacaacttcgtgaagaatacgggttttaa

SEQ ID NO: 419 - DNA, 831 bp, Nostoc punctiforme
atgacagaagctcaagcgatcgccaagcagttgggtggggtaaaaccagatgatgagtggttgcaagctgaaattgctcgtctcaagggtaagagtattgtgcctttacagcaggtaaaaactctccatgattggttggatggcaagcgtaaagcacggcaatcttgtcgagtcgttggggaatcacggactggcaagacggttgcctgtgatgcctataggtacaggcaaaagccacagcaagaagttgggcgacccccgattgtgcctgtagtttatattcagcctccgcaaaaatgcggctctaaggatttattcaaggagatgattgagtatcttaagtttcgagcaacaaagggaactgtttctgattttcgtgggagggcgatggaggtactcaaggggtgtggggtagaaatgctgattattgatgaagctgatcgcctcaaacctgagacgtttgctgaggtgcgagatatttatgacaagttaggaattgctgtggtattggtgggaacagaccgcttggaggcagtaatcaagcgagatgaacaagtctataaccgctttcgggcttgtcatcgcttcggcaagttatcggggaaagattttcaagatactgtgcaagcctgggaagatagagttttgaaactgcctgtttcttctaatttaactagcaaggatatgctgcggattctcacatcagcaactgaaggttacattggccgcctggatgagattctcagggaaacagcgattcgttctttatctaagggatttaagaagattgataaggctgttttacaggaagtggcgaaagagtacaagtga

SEQ ID NO: 420 - DNA, 501 bp, Nostoc punctiforme
atgacaacaccagatgttaagccttggctttttattatagaaccctatccaggggaaagcctaagtcattttctaggtcggtttagacgtgctaaccatttatctcctgctgggttgggtggtttagctgggattggtgctgtagtggcacggtgggaaagatttcattttaaccctcgccctagtcaaaaagagttggaagcgatcgcatctgtagtagaagtggatgcccaaaggttagcccagatgttaccacctgctggagtgggaatgcagcatgagccaattcgcttgtgtggggcttgttatgctgaagcgccttgtcacagaattgagtggcagtataagtcggtgtggaagtgcgatcgccatcaactcaaaattttagcgaagtgtccaaattgtcaagcaccttttaaaatgcctgccctgtgggaagatgggtgttgtcatagatgtaggactctgtttgcggaaatggcaaagcaacagaagagttaa

SEQ ID NO: 421 - DNA, 1866 bp, Scytonema hofmannii
atgttagacgaagaatttgagttcactgaggaattgacgcaagctccagatgttattgtgcttgacaagagtcattttgtggtagacccatcccaaattattctgcaaacatcggataagcataaactgagatttaatcttatcaagtggttcgctgaatcccccaacattactattaaatctcagagaaaacaggcagtcgtagatacccttggtgtttctactcggcaggtggagcgtctcctcaagcaatatcataatggtgagttatcagagacagcgggagtacaacgctcagataaggggaaacttcgcatcagccaatattgggaagattatattaaaacaacttatgaaaaaagtctgaaagataaacatccaatgttgccagcagctgtcgtgcgggaagtgaagcgacacgcgatcgttgacctcggactgaaaccaggagattatccccatccagccaccatctatagaaatttagctcctttaatcgagcaacacacgcggaagaaaaaagttagaaatccgggttcgggatcttggctgaccgttgtcacgcgagatggtcagctactgaaggctgactttagtaaccaaattatccaatgcgaccataccgagctggatattcatatagttgatagtcatggcagtttattgtctgaccgtccttggctaactactgttgtcgatacttattcaagttgcattcttggttttcatttatggatcaaacaaccaggttctacggaggtagctcttgccttaagacacgccattctacccaaaaattatcctgaggactacaaacttggcaaagtttgggaaatatatggacctccttttcaatatttttttactgatggtggaaaagattttaattcaaagcatctaaaagccattggtaagaaattaggatttcagtgcgaactacgcaatcgcccgccccaaggtggaattgtagaacgtctttttaaaaccattaatactcaagttcttaaagagcttcccggttacacgggggcaaacgttcaagaacgcccgaaaaatgcagagaaagaagcctgtttaacaatacaggatttggataaaattctagctagcttcttttgtgatatttataaccacgaaccctatcccaaggagcctcgcaacacgagatttgaacgctggtttaaaggtatggggggaaaattacccgaacctttggacgagcgagaattggatatttgtttgatgaaagaagcacaacgagttgttcaagctcatggtagcatacagtttgaaaacctaatttatcgaggagaagctcttaaggcatatagaggtgaatacgtcaccctaagatacgatcccgaccatgtcctgactttatatgtctatagttgcgaagctgatgataatgcagaagagttcttgggctatgctcacgctataaacatggatactcatgacttgagtatagaagaattgaaaactctcaataaagaacgaagtaaagctcgtagcgatcattacaactatgatgctttattagcattgggtaaacgcaaagaacttgtagaagaaagaaaacaagacaagaaagcaaaaaggcaatcagagcaaaaacgtctccgcactgcttccaagaaaaactcaaatgttattgaactacgcaaaagtagagcttcgagttcttcaagtaaagatgaccgacaggaaattttaccagagagagtttctagggacgaactaaagccggagaagacagaactgaaatatgaggaaaatctgttagcacagaccgatactcaaaaacaggagagacataagttagttgtctctgaccgtaaaaaaaatttaaagaatatttggtga

SEQ ID NO: 422 - DNA, 855 bp, Scytonema hofmannii
atggcgatatctcaactggcaacccaaccatttgtcgaagtcttacctccagagttagatagcaaagctcaaattgctaaaactattgatattgaggagcttttcagaattaattttatcacaaccgatcggtcttcagaatgtttcagatggttagatgagctgcgtatcctgaaacaatgcggtcggatcattggaccaagaaatgtaggcaaaagccgagcagtgcttcactatcgtaatgaggataaaaaacgagtttcttatgtaaaggcttggtcggcatcgagttctaaacgtctattttcacaaatcttaaaggatattaaccatgctgcatcaacaggtaaacgacaggatttacgtccaagattagctggtagtcttgaactatttggattagaattggtcattgttgataatgctgaaaatcttcaaaaagaggcgctcttagatttaaagcaactttttgaagaatgccatgttcctattgtcttagttggaggtaaggagttagatgatattttagaagattttgatttgttgactaactttccaacgttatatgagtttgaacgattggaacatgatgattttataaaaacattaaagacaattgaattggatattttatctcttccagaagcgtctaagttaagtgagggtaacatatttgcaattttagctgagagtacaggtgggaaaataggaattttagtcaagatactaactaaagcagttttacattctcttaaaaagggatttggtaaagttgatgaaagcattttagaaaaaatcgcaagtcgttatggaacaaaatacgttcccattgaaaacaaaaatagaaatgattga

SEQ ID NO: 423 - DNA, 516 bp, Scytonema hofmannii
atgattgaagatgatgaaattcgtctaaggttgggctatgttgaaccacacccaggtgaaagcatcagtcattatttgggacggcttcgtcgatttaaggctaacagccttccttcaggatatgctctaggaaaaattgcgggtcttgggtctgttctgactcgatgggaaaagttgtacttcaacccatttcccactcaacaagaactagaggcattagcacaagtgattcaagtggaggttgagaaattaagagagatgctacccactaaaggtgtcacaatgatgcctcgacccattcgattatgtgcggcttgctatgcagagtcaccttatcaccggatcgagtggcagtttaaggacaaaatgaagtgcgatcgccatcagttgcgcttattaacaaaatgcacaaactgtcagacaccattccccattcctgctgattgggaaaaaggagaatgctcgcattgttttttgtcttttgctaagatggtgaagtgtcaaaagcgtcgttag

SEQ ID NO: 424 - protein, 560 aa, Anabaena variabilis
MLDDPDKGNQEPETHEIVTELSLDEQHLLEMIQKLIEPCDRITYGERQREVAGKLGKSVRTVRRLVKKWEQEGLTALQTATRTDKGTHRIDSDWQDFIIKTYKENNKDGKRMSPKQVALRVQTKAEELGQQKYPSYRTVYRVLQPIIEQKEQKEGIRHRGWHGSRLSVKTRDGKDLFVEHSNHVWQCDHTRVDLLLVDQHGELLSRPWLTIVVDTYSRCIMGINLGFDAPSSQVIALALRHAILPKRYGSEYGLHEEWGTYGKPEHFYTDGGKDFRSNHLQQIGVQLGFVCHLRDRPSEGGIVERPFGTFNTDLFSTLPGYTGSNVQERPEQAEKEACITLRELERLLVRYIVDKYNQSIDARLGDQTRYQRWEAGLIVAPNLISEEELRICLMKQTRRSIYRGGYVQFENLTYRGENLAGYAGENVVLRYDPKDITTLLVYRQKGNQEEFLARAYAQDLETEELSVDEAKAMSRRIRQAGKAISNRSILAEVRDRETFVNQKKTKKERQKAEQTIVQKAKKPVPVEPEEEIEVASVDSEPEYQMPEVFDYEQMREDYGW

SEQ ID NO: 425 - protein, 278 aa, Anabaena variabilis
MTSKQAQAVAQQLGDIPVNDEKIQAEIQRLNRKSFIPLEQVQMLHDWLDGKRQSRQSGRVVGESRTGKTMGCDAYRLRHKPKQEPGRPPTVPVAYIQIPQECGAKELFGVLLEHLKYQMTKGTVAEIRDRTLRVLKGCGVEMLIIDEADRLKPKTFAEVPDIFDKLEIAVILVGTDRLDAVIKRDEQVYNRFRACHRFGKFSGDEFKKIVDIWEKKVLQLPVASNLSSKTMLKTLGETTGGYIGLLDMILRESAIRALKKGLRKVDLATLKEVTEEYK

SEQ ID NO: 426 - protein, 167 aa, Anabaena variabilis
MEVPQIQPWLFQIEPLEGESLSHFLGRFRRANDLTPTGLGKAAGLGGAIARWEKFRFNPPPSRQQLEALANVVGVDADRLAQMLPSAGVGMKMEPIRLCAACYAESPCHKIEWQFKVTRGCARHKITLLSECPNCKARFKVPALWVDGWCNRCFLRFEEMAKYQKGL

SEQ ID NO: 427 - protein, 554 aa, Cyanobacterium aponinum
MTIDNQFSDSPELISQLSPEDQKIADVIENLLQPCDKKTYGKKLKQASDQLKKSVRTIQRYVKQWEENGLVGILQNNRADKGSYRIDPRLQDFILKTYREGNKGSKRMTPKQVYLRAVVQAENWGIKPPSHMTIYRILNPIIAEKENKKRIRSSGWRGSQLVLSTRSGTEIDVQYSNHVWQCDHTRADILLVDQFGELLGRPWITIVVDTYSRCIMGINLGFDAPSSQVVTLALRHAILPKSYSSDYELHEEWGTYGKPEYFYTDGGKDFRSNHLQQISLQLGFTCHLRSRPSEGGVVERLFKTLNTEVFSTLPGYTGANVQERPEDAEKEACLTLKELEILIVRYIVDNYNQRIDARMGEQTRFQRWESGLLSTPHIIPERELDICLMKQSRRKVQKGGHLQFENLIYKGQYLAGYEGETVILRYDPRDITGILIYRVENNKEIFLTRAYATDLEGDCLSLTDAKSSVKRIREKSKNVHNKSILMEIQQRHLFSEKKTKKQIQQEEQKQIKPNTSLSIFKPETEMDTQVESSQELSEEDLDIEMIDYGNLQQY

SEQ ID NO: 428 - protein, 277 aa, Cyanobacterium aponinum
MEAKEIAQQLGEVEQPNQSLQNELDRLSKKQFLFLDQVKIYHQWLNERLFMKHCCRVVGDSHTGKTSSSQAYCLRYKSTQESGKNPIFPVLYVSVPENATSKVFFETSIKSFGYRISKGTISDLRERMLTLLSRCQVKMMIIDEADRCKPETLSYIRDIFDHLNICIVLVGTDRLNTVLKRDEQVYNRFLPCYRYGLLDKESLIKTIKIWEIKILKLPVASNLSQGKKFNIIYSTSKGCLGTMDKLLRTSASMALIRGLSKIELNILEEAAHLFKDK

SEQ ID NO: 429 - protein, 163 aa, Cyanobacterium aponinum
MITNSFDSWILMLDPYQGESISHFLGRFRRENSLTVNNLGKATELYGAIARWEKFRFNPPPSSEQLKKLSAIVQVEVATLQTMFPSAPMKMTPIRLCSACYGEKPYHKMEWQYKEIYKCDRHQLKLLSECPNCGARFKFPSLWVDGWCHRCFTPFAEMKQQKD

SEQ ID NO: 430 - protein, 635 aa, Filamentous cyanobacterium
MSTDATSATCSPSQDSGLEQGQQGQPPMLLNEVSPEVQQKIDLIDAIFQTPDKKARREAILHAAKTLGKTTRTIRLMMEKVKNDGVATLAVGRKDEGQFRISEQWSNFIKVIYEWGQRDGSRININGVYTHLVALASQGEALRDKKYADRFKGYPQVLEDLVAGKHPSHVTVYKVVNFYLERKNKKVRHPGSPAEGQVIQTTEGIIELTHSNQVWQCDHTKLDILLVDGDGEVILQWDDQKQEIVGRPYLTLIMDSYSGCVAGFHLGFEAAGSHEVGLALRHAMLPKQYGSEYKLKAEWNVFGVPEYWLTDRAKEFKSNHLKQVSMQVGFKRRLRAFPSAGGLIESIFDKINKEVLSHFGGYTGSNITKRPKEAEKHACLTLDELEKRLVIYFVDHYNGHDYPKVANQKRSNRWKANLLTEPEVLDERELDICLMKVAHRKVEKYGCIRFEGLVYQGDCLVEYEGDEVSLRYDERNILALLAYERPQRDRPGKFIGEVRARDAKEEQLSLEELRWLKRKLKERGKEVDNNSIWAERLGLYQFIDEKRKSKRQRRKKAQQRRSQKTNKSQVVELFPQNAVPENQPEVQESETKESTLPTTDQPQPDIVKSKDTPASQPIASNVVAYDWNQLLEDNW

SEQ ID NO: 431 - protein, 316 aa, Filamentous cyanobacterium
MATSNAVPQPLDDDSQSVTAPQPDAAPQPAPLRPLAEPERSPEVQAEVERIRSSEAYKDISRDSALFFWLSLQRDSRSNGYVFGANFADLRKACQFYRMQYVQRRGTLYKIPMPVTYVDVEQYGSPIDLLVAILESLGSPFAKIGLLRDMRSRTFGTLNSFGVKLLIIGYAECLSYEAYNELLRLTRQLKISVILAGSMELREILGNFVNRRSKRYGEIYNNFLDFHEYRAFEKSDIETLLESWENQVLSSWDQKLALKDIPDVPAFLYQRCEGHAETLYEILRKIAIFKLDNPSHQLSKADIENMVSRRTIPKRS

SEQ ID NO: 432 - protein, 169 aa, Filamentous cyanobacterium
MDNEAFDLPRWCPEPYEGESIASYLVRFRSQEVAQISTPSSFSKAIGLGIALTRWEKFRFNPFPSEEEIQKFCGVVGLELERFKAMLPPEGERMKLEPIRLCAACYAEAPYHRLKWQFQSTEGCSKHKLRLLSKCPGCERPFTIPGLAVEGKCPCGMFYKRMAKSQKPY

SEQ ID NO: 433 - protein, 584 aa, Nostoc punctiforme
MNSQQNPDLAVHPSAIPIEGLLGESDITLEKNVIATQLSEEAQLKLEVIQSLLEPCDRTTYGQKLREAAEKLGVSLRTVQRLVKNWEHDGLVGLTQTGRADKGKHRIGEFWEKFITKTYNEGNKGSKRMTPKQVALRVEAKARELKDSKPPNYKTVLRVLAPILEKQEKAKSIRSPGWRGTTLSVKTREGKDLSVDYSNHVWQCDHTRVDVLLVDQHGELLSRPWLTTVIDTYSRCIMGINLGFDAPSSGVVALALRHAILPKQYGFEYKLHCEWGTYGKPEHFYTDGGKDFRSNHLSQIGAQLGFVCHLRDRPSEGGVVERPFKTLNDQLFSTLPGYTGSNVQERPKDAEKDARLTLRELEQLLIRYIVDRYNQSIDARMGDQTRFERWEAGLPTVPVPIPERDLDICLMKQSRRTVQRGGCLQFQNLMYRGEYLAGYAGETVNLRFDPRDITTILVYRQENNQEVFLTRAHAQGLETEQLALDEAEAASRRLRNAGKTISNQSLLQEVVDRDALVATKKSRKERQKLEQAVLRSAGVDESKTESLSSQVVEPDEVESTETVHSQYEDMEVWDYEQLREEYGF

SEQ ID NO: 434 - protein, 276 aa, Nostoc punctiforme
MTEAQAIAKQLGGVKPDDEWLQAEIARLKGKSIVPLQQVKTLHDWLDGKRKARQSCRVVGESRTGKTVACDAYRYRQKPQQEVGRPPIVPVVYIQPPQKCGSKDLFKEMIEYLKFRATKGTVSDFRGRAMEVLKGCGVEMLIIDEADRLKPETFAEVRDIYDKLGIAVVLVGTDRLEAVIKRDEQVYNRFRACHRFGKLSGKDFQDTVQAWEDRVLKLPVSSNLTSKDMLRILTSATEGYIGRLDEILRETAIRSLSKGFKKIDKAVLQEVAKEYK

SEQ ID NO: 435 - protein, 166 aa, Nostoc punctiforme
MTTPDVKPWLFIIEPYPGESLSHFLGRFRRANHLSPAGLGGLAGIGAVVARWERFHFNPRPSQKELEAIASVVEVDAQRLAQMLPPAGVGMQHEPIRLCGACYAEAPCHRIEWQYKSVWKCDRHQLKILAKCPNCQAPFKMPALWEDGCCHRCRTLFAEMAKQQKS

SEQ ID NO: 436 - protein, 621 aa, Scytonema hofmannii
MLDEEFEFTEELTQAPDVIVLDKSHFVVDPSQIILQTSDKHKLRFNLIKWFAESPNITIKSQRKQAVVDTLGVSTRQVERLLKQYHNGELSETAGVQRSDKGKLRISQYWEDYIKTTYEKSLKDKHPMLPAAVVREVKRHAIVDLGLKPGDYPHPATIYRNLAPLIEQHTRKKKVRNPGSGSWLTVVTRDGQLLKADFSNQIIQCDHTELDIHIVDSHGSLLSDRPWLTTVVDTYSSCILGFHLWIKQPGSTEVALALRHAILPKNYPEDYKLGKVWEIYGPPFQYFFTDGGKDFNSKHLKAIGKKLGFQCELRNRPPQGGIVERLFKTINTQVLKELPGYTGANVQERPKNAEKEACLTIQDLDKILASFFCDIYNHEPYPKEPRNTRFERWFKGMGGKLPEPLDERELDICLMKEAQRVVQAHGSIQFENLIYRGEALKAYRGEYVTLRYDPDHVLTLYVYSCEADDNAEEFLGYAHAINMDTHDLSIEELKTLNKERSKARSDHYNYDALLALGKRKELVEERKQDKKAKRQSEQKRLRTASKKNSNVIELRKSRASSSSSKDDRQEILPERVSRDELKPEKTELKYEENLLAQTDTQKQERHKLVVSDRKKNLKNIW

SEQ ID NO: 437 - protein, 284 aa, Scytonema hofmannii
MAISQLATQPFVEVLPPELDSKAQIAKTIDIEELFRINFITTDRSSECFRWLDELRILKQCGRIIGPRNVGKSRAVLHYRNEDKKRVSYVKAWSASSSKRLFSQILKDINHAASTGKRQDLRPRLAGSLELFGLELVIVDNAENLQKEALLDLKQLFEECHVPIVLVGGKELDDILEDFDLLTNFPTLYEFERLEHDDFIKTLKTIELDILSLPEASKLSEGNIFAILAESTGGKIGILVKILTKAVLHSLKKGFGKVDESILEKIASRYGTKYVPIENKNRND

SEQ ID NO: 438 - protein, 171 aa, Scytonema hofmannii
MIEDDEIRLRLGYVEPHPGESISHYLGRLRRFKANSLPSGYALGKIAGLGSVLTRWEKLYFNPFPTQQELEALAQVIQVEVEKLREMLPTKGVTMMPRPIRLCAACYAESPYHRIEWQFKDKMKCDRHQLRLLTKCTNCQTPFPIPADWEKGECSHCFLSFAKMVKCQKRR

SEQ ID NO: 439 - DNA, 1929 bp, Anabaena variabilis
atgagccaaatcactattcagtgtcgtcttgtagcttctgagccatcacgtcatcaactatggaagttgatggtagatttaaatacgccactgattaatgaattattggttcaggtagcccaacaccctgaatttgaaacttggcgacaaaagggcaaacacccagccaaaattgtcaaagaattatgcgagcctttgagaactgatcctcgcttcatcggtcaacctggacgtttttacacaagtgcgatcgccacagtaaattacatctacaaatcttggtttgcattgatgaagcgatcgcaatcccaactagaaggtaaaatgcgctggtgggaaatgcttaaaagcgatgccgaattagtagaagttagtggagttactttagagagtcttcgtactaaagctgctgaaatactgtctcaatttgctccccagccagatacagttgaagcacaaccagcgaaaggaaagaaacgtaagaaaaccaaaaaatcagatggcgattgcgcggagcgcacgctacgcgaacgtagtatttctgattatttgtttgaagcttaccgcgacacagaagaaatattgacacgttgtgcaattaactatttactgaaaaatggttgcaaaatcagcaataaagaggaaaatgctgaaaaattcgctaaacgccgccgcaaactggagattcaaattgaacgcctaagagaaaaactagaggcacgaatccccaaaggtcgagacttaacggatgccaaatggttagaaactcttttgctggccactcttaatgttcctgaaaatgaagcggaggcgaaatcttggcaagacagtctgctaaaaaaatctatcacagtacctttcccagtcgcttatgaaaccaacgaagacatgacttggtttaaaaacgaaaggggacgtatctgtgtaaaatttagcggactgagtgagcatacttttcaagtctattgcgattctcgccaactccaatggtttcaacgttttttagaagaccagcaaatcaaacggaacagtaaaaaccaacactctagcagcctattcactctccgtagtggacgtattgcatggcaagagggggaaggtaaaagtgaaccttggaaagttaaccgcttaatcctttactgttctgtagatactcgcctgtggacggctgaaggaacaaacctagtccgagaagaaaaagcagaagaaattgctaaagctatcgcccaaacaaaagccaaaggcaaactcaacgataaacaacaagctcatataaaacggaaaaactcttctctagccagaattaataacctctttccccgccccagcaagcccttatataaaggtcaatctcatattcttgttggtgttagccttggtttagagaaacctacaacactagcagtggttgatggctctataggtaaagtgcttacttaccgcaatattaaacaactactaggcgataattacagacttttaaatagacaacgacaacaaaaacacaccttatcccatcaacgccaagtagctcaaatcctggcttcaccgaatcaacttggggaatcagagttgggacagtatgtagacagattactagctaaagaaattgtagcgatcacccaaacatataaagctggctctattgtcctgcctaaattgggcgatatgcgagaacaggtgcaaagtgagattcaagctaaagccgaacagaaatcagacttaatagaagttcaacaaaaatattccaaacagtaccgagttagcgtccatcagtggagctatggtcgattgattgcaagtattcgctcgtcagcagctaaagttggaattgtgattgaggaatcgaaacaaccgattcgaggtagtccacaggagaaagcgagagaattagcgatcgctgcttataattctcgccgaagaacctga

SEQ ID NO: 440 - DNA, 1872 bp, Cyanobacterium aponinum
atggttcaggtaactattcaatctcgtttaatcgcttctgctgatactcgtcaatctctctggttgttgatgagcaagaaaaatactcctttgatcaatgaaatccttacccgaattaaacatcatcccgattttcctcaatggcgagagaaaggaagactgccgaaaaactttattgctcaacaaattcaagagctaaaaaatgattctcgttttcaaggacaaccatctcggttttatgcttctgtcggtaaaatcatcgactacatatacaaatcttggttcaaagtgcaaaagagttacaaaatccaattagaaggtaatagccgttggttagaaatgttgaaacccgatagtttattaatagaatcctttgatggttcaatggaagcactgcaaaatcaggctcaacagattctcgataatattgaaacgacttctactcaagaaggtattgttgattatttatttcaaaaatatgagaaaatagaaaattgtcgaatgaaggatgcgatcgtttatctgatcaaaaatggtagtcgtattcctaagaacaatattgaaacaaccaagaaatataaaagaatcaaaagaaaattagaaatcaaaattcgtaaattgaaaagacaagtggaaatgtctattccttctggcagagatttagagggagaaaaatggttgcacactctcatccttgcttctaacacgatgccagtagatcaaagtgagagtgatagttggttttcagcactgaaacgaaattctccgtcaattccctatcctattgtttatgaaagcaatgaggatttaacatggtgtttgaataaccaaaaccgtatttgtattaaatttagtggtttgagtgaccatctttttcaaatctattgtgattctcgtcaactggcctattttcggcgtttttatgaggatcaggaattgaaaaaagccagtaaagatcagttttcgagtgctttatttactctgcgatcggctatgatcatttggaaagaagatgatggaaaaggagagtcgtgggataaacataaactctatttacattgtacttttgatacagattattggactgtggaaggtacacaagtcattgctcaaaaaaagcaggaggaagtgctaaatctcattgataggatgaaggaaaagacggatttaacagatactcaaaaggcatttattcaacggaaacaaacgactcttgcccgacttaataatatttttcctcgccctagtaagcctatttatcaaggtaatccgaatctttttctcggtgtagcaatgggtttacaagaaccagttacgatcgcacttgtggatgtcagcacaaataaagtgattctctatcgtaatatcaagcaattattgggagataattaccatctactcaggaggagaagaaatgagaaacagaaattgaatcaccaaaaccataaagcaaggaaaagagctaattttcaacaaaagggggaatctaatctgggtgaatacctcgatcgcctcattgccaaatccattcttcaaatcgctaaagagtaccaagtatcaactattatcgttcctcgattaaatcagatgcgatcgattacggaggcagaaatacaagcaagggcggaggagagaataccagaatataaggaggggcaacgaaaatatgcacaggattatcgtgtacaggtgcatcaatggagttatggcagattgattgacaatatcaaagcgatttcttctaaattgggtattgtcgtagaggaaggcaaacaacccaaacaaggaacatttaccgataaggcatcacagttagcattgagtacccagaaaaataatcgccaaaataatcccaaaaagacaaattcttaa

SEQ ID NO: 441 - DNA, 2268 bp, Filamentous cyanobacterium
atggttaaatatacgcttctggtcaaccgcctgctagaacaagttgggcagttgtctgagtttaagcagtggcaagaaaagggcagtatctcgaaagagcctgtcaagcagttatgtgatgcccttaagaaacaccatgcagagtttcaggggttgccacaccgcttctacatctcagccaaacttatggtgacttataccttcgagtcttggctagcgttacaacaacgacgacggcgcaaaattgatggcaaacgacgctggttaaaccgagttgaagatgatattgaacttgcaaaagtgacggactttagcccagaaatgattcagaatcgggctaggaaaatcctagcagagatacatccatctaaccctgttgaacctgaacctgagacatcttcagacaatgaaataaatgaaggagagaactgccaggaagaggaagagatgaatcaacccaaatctcttctttcctgcttgtttgatttgtacgacagtacggaagatgcgcttactctccgggcgatcgttcatttgctcaaaaataatggtgaagtgaatgaggaagacgaagatcctaaaaagcttgaactgcgtttagccgccaagcgcgaggaaattcagaggttagagaaacaactgcaaggacgtttaccaaaaggacgcgatccaacgggtgaaactaccactcgttttttagaagaggctattaagctacctgaacacccaaccgcctatccaccccggtttcttctcaacgccttttattgctacgccttactgccaatgccgtacatccagtacggagtctatctcctcaatgccattttggatgaagccaggatcgttgagtctgacttcatcacctggagagatacgatcgcagaacatctggtgaacgcggctaaacgacccaactccttgccctatccgcttatctttggcagtactagcgatctggtttgggaatcagaatcgaaaagaaaaggtcccaacgctcctgatacagagggagcattggagcaatcaggagccaaatcatcaagaaagcgtccatctaagcgaaagcggacaaggctcaaaacacaatcagatgagagaatcaccgtacgctttcatggcatgagccagtatcgcttcaaaatctactgcgatcgacgccagcttccgatatttcgccagtttctgactgactactgtacgcataaggcacttgacgaagagaataagttttccatgggcttgtttgccctccgttcagctagcttaatctggaaaaaagacaaacaacgtcctcacaaacgtaactcttcggagccagttgaaccgttgtcgccttggcaaactcatcgactttatttgcactgttccatcgattctcgcttgttaaccgctgaaggaacggaacaagttcgcttccagaagatcctccagactaaacggaaattagaaggggcaaagaataaagaacaagaaattctcagacaaaaatctgaacgtcaacataccgagtcggaacaagacttagacgataaactgaagaaacagcggcagaatgttgcacggaatcaaaccagtttaaattgcctgtataatcctacaccgccacgccctagtcgagttcgctatcaaggaaatcctaacattgctataggggtcagcttttgtcgtcaacaacttgttggagtgggagtaattgatctgcaaacgcaacaagtgcaggaatactacagtatccggagattactgatcaatcgtaaagttactcaagtaaaacgtggtcgcagcgttcttcagttaaagctaaaaaaatatcggttagtcaaccaattatgtatgtggaagaagaagaacattactcaacgaacccaacaacaaaagcaaggactgtgcattcaaaacaccactgaatctaatctaagacagtatctggaacgattagttgcagaccgaattgtggaagtggcactgaagcaccaagccggaagtattgtcacaccgcaactgggagagatccgcgagagtattgaaagtgccgttcaagcaatagccaagcaactcttcgagaatcaccgagaggcgcaacaggcgtacgcgaagcagtttcgcatggattttcatcggtggagttacggtcgattaaccgactgtattcatagccgtgctcgtcaggagggaattctagttcaagctggacgacaacctgtcgagggcaatcttgttggtaaagccctcacaattgccttatcagggcgaaatttggtctag

SEQ ID NO: 442 - DNA, 1920 bp, Nostoc punctiforme
atgagtcagattactatccagtgccgtcttattgccagtgaatcaacccgccaaaaactgtggaaattgatggcaactttaaacacacccttaattaatgaactaattgaacaacttggtaaacacccagacttcgagaattggcgacaacaaggtaagcttccaacaactgttgttagtcaactgtgccaacctctcaagactgaccctcgctttgtaggtcaacctagccgtttatatatgtcggcgattcatattgtggactacatctacaagtcttggctggctatacaaaaacgtctacagcaacagctagacggcaaaatgcgctggctagaaatgctcaacagtgatgttgaacttgtggaaactagcggttctagtatgggggctattcgtaccaaagcctctgaaattttggcaaaagctatgccaacatctgactcagatagctctcaacccaaaacaaaaaagggcaaggaggctaaaaaatcctcgtcatctagttctgaccgcagtttatccaataaattatttgaagcttaccaagagacagaagacatccttagccgcagcgccatcagctacttattgaaaaatggctgcaaacttagcgataaagaagaagattcagaaaaatttgctaaacgtcgtcgtcaagttgaaatccaaattcaaaggcttaccgaaaagttaataagtcggatgcctaaaggtcgagatttgaccaatcgtaaatggttagagacactcttcactgctacaaccacctttcctgaagataacgccgaagccaagcgctggcaggatattctattaactcgaccaagttctcttccattcccccttgtttttgaaacgaacgaggatatggtttggtcaaagaatcaaaaaggtaggctgtgtgttcacttcaatggattgagcgatcttagctttgaggtatactgcgacaatcgccaacttcactggtttcaacgtttcctagaagatcaacaaactaaacgccaaagtaaaagccagtattctagtggcttattcactctcagaaatggtcacctagtttggcaagaaggagagggtaagagcgaaccttggaaccttaaccgattgaacctctactgctgtgttgacaatcgcctatggactgctgacggaacagaacaggttcgccaagagaaagcagaagaaattagcaaactcatcacgaagatgaaagaaaaaagtgacctaaaggatacacagaaagcttttattcaacgtaaagaatcaacgcttaatcgaatgaataatagctttgagcgtcctagtcaacccctttaccaaggtcaatcacacattttggttggagtaagcctgggactagaaaaacctgccaccgtagctgtagtagatgcgatcgcaggtaaagttctagcttaccggagtatccgccagttacttggcgacaattacgaacttctgaatcggcaaagacgacaacagcgatcatcatcccacgaacgccacaaagcacaaaaaagcttctctcccaatcaatttggtacatctgagttagggcagtatgtagacagattattggctaaagaaattattgcgatcgcacaaacctataaagctggcaatatagttttgcctaagctaggggatatgcgagagattgttcaaagtgaaattcaagctatagccgaagcaaaatgtccaggctccgtagaagttcagcaaaaatacgccaaacaataccgagttaatgttcacaagtggagctatggcagattaatacagagtattcaaagtaaaggtagtcaggcaggaattgtgattgaagagggaaaacaacctgttagaggtagccctcatgaacaagcaaaggaattagcactttctgcttaccatgatcggctagctaggcgaagttga

SEQ ID NO: 443 - DNA, 1938 bp, Scytonema hofmannii
atgagcacaatcacgattcaatgccgcctagttgcagaagaagcgaccctgcgctacttttgggaacttatggctgagaagaatacgccactcattaatgaattgttggagcagttaggacaacatccagattttgatacttgggtacaagcaggcaagatgcctgaaaagacagttgagaacttgtgcaagtccctagaagatcgagaaccttttgcaaatcagcccggtcgttttcgtacttcggcagttgctctggtaaagtacatttacaaatcctggtttgcgttacaaaaacgacgggcggacagactagaaggtaaagagcgctggttaaagatgctcaaaagtgatgtggaactggaacgagaaagcaattgtagtttggatattattcgagctaaagctggggaaattcttgctaaagttactgaggggtgcgctccgagcaatcaaacatcctctaagagaaaaaagaagaagactaaaaaaagccaagcgacaaaagatctccctacgcttttcgagattatattaaaagcttacgaacaagctgaagaaagcctgacacgagctgcccttgcttatctccttaaaaatgactgtgaagtcagtgaagttgatgaagattcagagaaatttaaaaagcgacggcgaaaaaaggaaatagaaattgaacgtttaagaaatcaactgaaaagtcggatacctaaaggtcgcgatttaaccggagataagtggttgaaaacgctagaagaagccacccgaaatgttcctgaaaatgaggatgaggcaaaagcttggcaagcccaactcttaagagaagctagttctgttccttttcctgtagcttatgaaactagtgaagatatgacttggtttaccaacgagcaaggtcgaatctttgtttactttaatggttcagccaaacataaatttcaagtttattgcgatcgccgtcaacttcattggtttcaacgttttgtagaagactttcaaatcaagaaaaatggtgataaaaaaggtagcgaaaaggagtaccctgctgggttattgacgctttgttccactcgtctgagatggaaagaaagcgcggaaaaaggagatccttggaatgttcatcgcctaattctttcttgcactatcgatacacgcttatggacacttgaaggaacggaacaggtgcgagctgaaaagatcgctcaggttgaaaaaactattagcaagcgggagcaagaagttaatctgagtaagactcaacttgagcgtttacaagccaagcacagtgagagggagagattgaacaatatttttcccaaccgccctagcaagcccagttaccggggtaaatctcatattgcgatcggtgtaagcttcagtttggaaaacccagccactgttgccgtcgtagatgttgcaaccaagaaagtccttacttaccgcagtttcaaacaattactcggagataactacaaccttgcaaaccggctgcggcaacaaaagcaacgtctttctcacgaacgtcacaaagctcagaaacaaggcgcaccaaattcatttggagactcagagttagggcagtatgtagacagattgctagcaaaatcgattgtcgcgatcgcaaaaacttatcaagctagtagtattgtcttgcctaaacttcgctatatgagggaaatcatacataatgaagttcaagctaaagccgaaaaaaagattccaggatataaagaaggtcaaaaacaatatgccaaacagtatcggataagcgttcatcaatggagttataatagattatcacagattcttgaaagccaagctacaaaagctggaatttcaattgaacgtggatcgcaagtaatccaaggtagctcccaagaacaagcacgagatttagctttatttgcctataacgaacgccaacttagtctgggttag

SEQ ID NO: 444 - protein, 642 aa, Anabaena variabilis
MSQITIQCRLVASEPSRHQLWKLMVDLNTPLINELLVQVAQHPEFETWRQKGKHPAKIVKELCEPLRTDPRFIGQPGRFYTSAIATVNYIYKSWFALMKRSQSQLEGKMRWWEMLKSDAELVEVSGVTLESLRTKAAEILSQFAPQPDTVEAQPAKGKKRKKTKKSDGDCAERTLRERSISDYLFEAYRDTEEILTRCAINYLLKNGCKISNKEENAEKFAKRRRKLEIQIERLREKLEARIPKGRDLTDAKWLETLLLATLNVPENEAEAKSWQDSLLKKSITVPFPVAYETNEDMTWFKNERGRICVKFSGLSEHTFQVYCDSRQLQWFQRFLEDQQIKRNSKNQHSSSLFTLRSGRIAWQEGEGKSEPWKVNRLILYCSVDTRLWTAEGTNLVREEKAEEIAKAIAQTKAKGKLNDKQQAHIKRKNSSLARINNLFPRPSKPLYKGQSHILVGVSLGLEKPTTLAVVDGSIGKVLTYRNIKQLLGDNYRLLNRQRQQKHTLSHQRQVAQILASPNQLGESELGQYVDRLLAKEIVAITQTYKAGSIVLPKLGDMREQVQSEIQAKAEQKSDLIEVQQKYSKQYRVSVHQWSYGRLIASIRSSAAKVGIVIEESKQPIRGSPQEKARELAIAAYNSRRRT

SEQ ID NO: 445 - protein, 623 aa, Cyanobacterium aponinum
MVQVTIQSRLIASADTRQSLWLLMSKKNTPLINEILTRIKHHPDFPQWREKGRLPKNFIAQQIQELKNDSRFQGQPSRFYASVGKIIDYIYKSWFKVQKSYKIQLEGNSRWLEMLKPDSLLIESFDGSMEALQNQAQQILDNIETTSTQEGIVDYLFQKYEKIENCRMKDAIVYLIKNGSRIPKNNIETTKKYKRIKRKLEIKIRKLKRQVEMSIPSGRDLEGEKWLHTLILASNTMPVDQSESDSWFSALKRNSPSIPYPIVYESNEDLTWCLNNQNRICIKFSGLSDHLFQIYCDSRQLAYFRRFYEDQELKKASKDQFSSALFTLRSAMIIWKEDDGKGESWDKHKLYLHCTFDTDYWTVEGTQVIAQKKQEEVLNLIDRMKEKTDLTDTQKAFIQRKQTTLARLNNIFPRPSKPIYQGNPNLFLGVAMGLQEPVTIALVDVSTNKVILYRNIKQLLGDNYHLLRRRRNEKQKLNHQNHKARKRANFQQKGESNLGEYLDRLIAKSILQIAKEYQVSTIIVPRLNQMRSITEAEIQARAEERIPEYKEGQRKYAQDYRVQVHQWSYGRLIDNIKAISSKLGIVVEEGKQPKQGTFTDKASQLALSTQKNNRQNNPKKTNS

SEQ ID NO: 446 - protein, 778 aa, Filamentous cyanobacterium
MQLRVICCCLSADEATRQFFWEAMVKYTLLVNRLLEQVGQLSEFKQWQEKGSISKEPVKQLCDALKKHHAEFQGLPHRFYISAKLMVTYTFESWLALQQRRRRKIDGKRRWLNRVEDDIELAKVTDFSPEMIQNRARKILAEIHPSNPVEPEPETSSDNEINEGENCQEEEEMNQPKSLLSCLFDLYDSTEDALTLRAIVHLLKNNGEVNEEDEDPKKLELRLAAKREEIQRLEKQLQGRLPKGRDPTGETTTRFLEEAIKLPEHPTAYPPRFLLNAFYCYALLPMPYIQYGVYLLNAILDEARIVESDFITWRDTIAEHLVNAAKRPNSLPYPLIFGSTSDLVWESESKRKGPNAPDTEGALEQSGAKSSRKRPSKRKRTRLKTQSDERITVRFHGMSQYRFKIYCDRRQLPIFRQFLTDYCTHKALDEENKFSMGLFALRSASLIWKKDKQRPHKRNSSEPVEPLSPWQTHRLYLHCSIDSRLLTAEGTEQVRFQKILQTKRKLEGAKNKEQEILRQKSERQHTESEQDLDDKLKKQRQNVARNQTSLNCLYNPTPPRPSRVRYQGNPNIAIGVSFCRQQLVGVGVIDLQTQQVQEYYSIRRLLINRKVTQVKRGRSVLQLKLKKYRLVNQLCMWKKKNITQRTQQQKQGLCIQNTTESNLRQYLERLVADRIVEVALKHQAGSIVTPQLGEIRESIESAVQAIAKQLFENHREAQQAYAKQFRMDFHRWSYGRLTDCIHSRARQEGILVQAGRQPVEGNLVGKALTIALSGRNLV

SEQ ID NO: 447 - protein, 639 aa, Nostoc punctiforme
MSQITIQCRLIASESTRQKLWKLMATLNTPLINELIEQLGKHPDFENWRQQGKLPTTVVSQLCQPLKTDPRFVGQPSRLYMSAIHIVDYIYKSWLAIQKRLQQQLDGKMRWLEMLNSDVELVETSGSSMGAIRTKASEILAKAMPTSDSDSSQPKTKKGKEAKKSSSSSSDRSLSNKLFEAYQETEDILSRSAISYLLKNGCKLSDKEEDSEKFAKRRRQVEIQIQRLTEKLISRMPKGRDLTNRKWLETLFTATTTFPEDNAEAKRWQDILLTRPSSLPFPLVFETNEDMVWSKNQKGRLCVHFNGLSDLSFEVYCDNRQLHWFQRFLEDQQTKRQSKSQYSSGLFTLRNGHLVWQEGEGKSEPWNLNRLNLYCCVDNRLWTADGTEQVRQEKAEEISKLITKMKEKSDLKDTQKAFIQRKESTLNRMNNSFERPSQPLYQGQSHILVGVSLGLEKPATVAVVDAIAGKVLAYRSIRQLLGDNYELLNRQRRQQRSSSHERHKAQKSFSPNQFGTSELGQYVDRLLAKEIIAIAQTYKAGNIVLPKLGDMREIVQSEIQAIAEAKCPGSVEVQQKYAKQYRVNVHKWSYGRLIQSIQSKGSQAGIVIEEGKQPVRGSPHEQAKELALSAYHDRLARRS

SEQ ID NO: 448 - protein, 645 aa, Scytonema hofmannii
MSTITIQCRLVAEEATLRYFWELMAEKNTPLINELLEQLGQHPDFDTWVQAGKMPEKTVENLCKSLEDREPFANQPGRFRTSAVALVKYIYKSWFALQKRRADRLEGKERWLKMLKSDVELERESNCSLDIIRAKAGEILAKVTEGCAPSNQTSSKRKKKKTKKSQATKDLPTLFEIILKAYEQAEESLTRAALAYLLKNDCEVSEVDEDSEKFKKRRRKKEIEIERLRNQLKSRIPKGRDLTGDKWLKTLEEATRNVPENEDEAKAWQAQLLREASSVPFPVAYETSEDMTWFTNEQGRIFVYFNGSAKHKFQVYCDRRQLHWFQRFVEDFQIKKNGDKKGSEKEYPAGLLTLCSTRLRWKESAEKGDPWNVHRLILSCTIDTRLWTLEGTEQVRAEKIAQVEKTISKREQEVNLSKTQLERLQAKHSERERLNNIFPNRPSKPSYRGKSHIAIGVSFSLENPATVAVVDVATKKVLTYRSFKQLLGDNYNLANRLRQQKQRLSHERHKAQKQGAPNSFGDSELGQYVDRLLAKSIVAIAKTYQASSIVLPKLRYMREIIHNEVQAKAEKKIPGYKEGQKQYAKQYRISVHQWSYNRLSQILESQATKAGISIERGSQVIQGSSQEQARDLALFAYNERQLSLG

SEQ ID NO: 449 - protein, 646 aa, Nostoc carneum
MSQITIQCRLVASESTRQQLWKLMADLNTPLINELLEQLAKHPDFEKWRQKGKLPASVVMKLCQPLKNDPRFAGQPSRFYISAIHIVDYIYKSWLAIQKRLQQQLDGKTRWLEMLNSDPELVEASASSLEVIRTKAAEILAIAMTASDSDNSSPNGKKSKKAKKASSNPKRKLFNTLFDAYQETEDVLSRSAISYLLKNGCKLSDKDEDPEKFAQRRRQLEIQIQRLTEKLTSRIPKGRDLTHAKWLETLFTATTTVPKDNAEAKHWQDILLTRSSSVPFPVVFETNEDLVWSTNEKSRLCVHFNGLSDLTFEVYCDSRQLHWFKRFLEDQQTKRKSKNQHSSGLFTLRNGRLAWQQGEGKGEPWQLHRLTLYCCVDNRLWTAEGTEQVRQEKAEEITKFITKMNEKSDLSDTQFAFIKRKESTLTRINNSFDRPSKPLYQGQSHILVGVSLGLEKPATVAVVDAMPDGKADANAGKVLTYRSIRQLLGDNYKLLNRYRREQRSLSHERHKAQKSFSPNQFGASELGQYIDRLLAKEIIAIAQTYKVGSIVLPKLGDMREIVQSEIQAIAEAKCPGSLEIQQKYAKQYRVNVHSWSYGRLIQSIQSKAAQAGIMIEAGKQPIRGSPQDKAKELALSAYHDRLARRS

SEQ ID NO: 450 - protein, 639 aa, Hassallia byssoidea VB512170
MSQITIQCCLIASESTRQKLWKLMAHLNTPLINELLQQLSKHPDFEKWRKNGKLPSTVVNQLCQPLKTDPSFTGQPSRLYLSAIHVVDYIYKSWLAIQKRLQQQLDGKIRWLEMLNSDAELIEISGCSLEAIRTKAAEILAIATPDSDVAAPLTKTGKAKKSKKSSASNPDRSLSHKLFDAYQETDDILSRSAISYLLRNGCKLNDKEEDLEKFAKRRRKVEIQIQRLTDKLTSRIPKGRDLTNAKWLETLFTATTTVPEDNVEAKRWQDILLTRSSSVPFPLIFETNEDLVWSKNEKGRLCVHFNGLSDLTFEVYCDRRQLHWFKRFLEDQQTKRKSKNQHSSGLFTLRNGRLAWQEGEGKGEPWQINRLTLYCCVDNRLWSAEGTEQVRQEKEEEITKFITKMNEKSDLSETQQAFIKRKESTLTRINNSFERPSQFLYQGQSHILVGVSLGLEKPATVAVVDAIAGKVLAYRSIKQLLGDNYELLNRQRRQQQYLSHERHKAQKSFSPNQFGTSELGQYVDRLLAKEIIAIAQTHKAGSIVLPKLGDMREIVQSEIQAIAEEKFPGYVEGQQKYAKQYRVNVHGWSHSRLIQSIQSKAAQIGIVIEEGKQPIRGSPQDKAKELALSAYNLRLARRS

SEQ ID NO: 451 - protein, 647 aa, Nostocales
MSQITIQCRLIASESTRQQLWKLMAESNTPLINQLLQQLSKHPDFEKWRKNGKLPSTVVYQLCQPLKTHPSFTGQPSRFYLSAIHVVDYIYKSWLAIQKRLQQQLDGKLRWIEMLNSDAELVEISGCSLEAIRTKAAEILAMTTPESGSNISVTKTRKTKKSKNSNSSASNSDRSLSHKLFDAYQETDDILSRSAISYLLKNACKLNNKEEDPEKFSQRRRKVEIQIQRLTDKLISRIPKGRDLTNSKWLETLFTATTTVPEDNTEAKRWQDVLLTRSSSVPFPVIFETNEDLVWSKNEKGRLCVHFNGLSDLTFEVYCDSRQLHWFKRFLEDQQTKRKSKNQHSSGLFTLRNGRLAWQEGKGKEEPWNIHHLTLYCCVDNRLWTEDGTEQVRQEKAEEITKFITKMNEKSDLSDTQLAFIKRKESTLTRINNSFDRPSKPLYQGQSHILVGVSLGLEKPATIAVVDAMPDGKADANAGKVLTYRSIRQLLGDNYELLNRQRRQQRSLSHERHKAQKSFSSNQFGTSELGQHIDRLLAKEIVAIAQTYKAGSIVLPKLGDMREIVQSEIQAIAEAKCPGYVEIQQKYAKQYRVNVHQWSYGRLIQSIQSKAAQVGIMVEEGKQPIRGSPQDKAKELALSTYHSRLAR

SEQ ID NO: 452 - protein, 648 aa, Nostoc sp. PCC 7120
MCFVWYFIFMSQKTIQCRLIASESTRQKLWKLMAESNTPLINELLQQLSKHPDFEKWRRNGKLPSTVVSQLCQPLKTDPSFTGQPSRFYISAIHIVDYIYKSWLTIQKRLQQQLDGKLRWIEMFNSDVELVEISGFSLEAIRTKASEILAITTPESDPKTLLTKRGKTKQSKKSSASNPDRSLSRKLFDAYQETDDILSRSAISYLLKNGCKLNDKEENPEKFAKRRRKVEIQIQRLTDKLTSRIPKGRDLTYSKWLETLFTATTTVPENNAEAKRWQDILLTRSSSIPFPVVFETNEDLVWSTNEKGRLCVHFNGLSDLIFEVYCDSRQLYWFKRFLEDQQTKRKSKNQHSSGLFTLRNGRLAWQQGEGKGEPWNIGHLALYCCVDNRLWTAEGTEQVRQEKAEEITKFITKMKDKSDLSETQLAFIKRKESTLTRINNSFDRPSKPLYQGQSHILVGVSLGLEKPATIAVVDAIAGKVLTYRSLRQLLGDNYELLNRQRRQQRSLSHERHKAQKSFSPNQFGASELGQYVDRLLAKEIVAIAQTYKAGSIVLPKLGDIREIVQSEIQAIAEAKCPSSSEIQQKYAKQYRVNVHQWSYGRLIQSIQSKAAQIGIVIEEGKQPIRGSPQDKAKELALYAYSLRLARRS

SEQ ID NO: 453 - protein, 636 aa, Nostoc sp. 'Peltigera membranacea cyanobiont' 232
MSQITIQCRLVASESSRHQLWKLMAELNTPLINELLHRVNQHPEFETWRQKGKHPTSVVKELCEPLKTDSRFIGQPGRFYTSAIALVNYIYKSWFALMKRSQFQLEGKNRWLQMLNSDVELIESSGVSLDSLRTKAAEILAQFASLNTAETPSTNVKKAKKRKKAQNSDSDRNLSKNLFESYPKTEDNLTRCAISYLLKNGCKINDKEEDAKKFVQRRRKLEIQIERIREQLETRTPKGRDLTATKWLATLFTATHNVPTNEAEAKSWQDSLLRQFSKVPFPVAYESNEDMTWFKNQFGRICVKFNGLSEHSFQVYCDSRQLHWFQRFLEDQQIKKNSKNQHSSSLFTLRSGRLAWQEEEGKGDPWKANHLTLYCSVDTRLWTTEGTNQVREEKAEEIAKIITNTKAKGDLNEKQQAHIKRKNSTLDRINNPFPRPTKTLYKGQSHILVGVSLGLEKPATLAVVDGTTGQVITYRSIKQLLGDNYKLVNRQRKQKHSLSHQRQIAQTLAAPNQFGESELGEYIDRLLAKEIIAIAQTYSAGSIVLPKLDNMREQVQSEVQAKAEQKSDLIEVQKQYAKQYRVSVHQWSYGRLMANIHSSAVKAGIVIEESKQPIRGSPQEKAKELAIAAYHSRKIN

SEQ ID NO: 454 - protein, 635 aa, Microcoleus sp. PCC 7113
MSQITIQCRLVANVSTRHQIWTLMAERNTPLINELLEQIGQHPDFETWRQKRKIPAGIIKQLCEPLRTDSRFIGQPGRFYASASALVDYIYKSWLKVQQRLQRKLEGQMRWLGMLKSDEELVNQSGCTLEVIRTKASEILVPLTSKNESPQPTQTKGKKSKKPQDLGSNRSISKTLFQVYDDIEDLLTKNAICYLLKNGCKIPDQEEDKEKFAKRRRKTEIKISRLEEQLASRIPKGRNLTGEKWLETLIAATSTVPENESQARSWQDRLLTKPQSVPFPVTYESNEDLTWSKNSKGRLCVKFNGLSEHTFQIYCDQRQLKWFQRFLEDQQIKRESKDQHSSSLFTLRSGQIAWALGKGKGDAWNIHHLTLYCTLDTRLWTAEGTEQVRQEKADDIAKTLARMKEKGDLNDKQQAFIKRKNSTLARLNNPFPRPSQPLYQGRSHIAVGISLGLGKPATAAIVDGTTGEAIAYRSIRQLLGDNYKLFNRQRQEKQRQSHQRHKAQKNATSNQFGESELGEYVDRLLAKEIVTLAQTYQAGSIVLPKLGDMRELVHSEIQTRAEQKIPSYVEGQQKYAKQYRVNVHQWSYGRLIENIQVQAAKIGISIEQGQQPVRGSPQEKAKEMAIAAYHSRLNP

SEQ ID NO: 455 - protein, 639 aa, Nostocaceae
MSQKTIQCRLIASESTRQKLWKLMAESNTPLINELLQQLSKHPDFEKWRRNGKLPSTVVSQLCQPLKTDPSFTGQPSRFYISAIHIVDYIYKSWLTIQKRLQQQLDGKLRWIEMFNSDVELVEISGFSLEAIRTKASEILAITTPESDPKTLLTKRGKTKQSKKSSASNPDRSLSRKLFDAYQETDDILSRSAISYLLKNGCKLNDKEENPEKFAKRRRKVEIQIQRLTDKLTSRIPKGRDLTYSKWLETLFTATTTVPENNAEAKRWQDILLTRSSSIPFPVVFETNEDLVWSTNEKGRLCVHFNGLSDLIFEVYCDSRQLYWFKRFLEDQQTKRKSKNQHSSGLFTLRNGRLAWQQGEGKGEPWNIGHLALYCCVDNRLWTAEGTEQVRQEKAEEITKFITKMKDKSDLSETQLAFIKRKESTLTRINNSFDRPSKPLYQGQSHILVGVSLGLEKPATIAVVDAIAGKVLTYRSLRQLLGDNYELLNRQRRQQRSLSHERHKAQKSFSPNQFGASELGQYVDRLLAKEIVAIAQTYKAGSIVLPKLGDIREIVQSEIQAIAEAKCPSSSEIQQKYAKQYRVNVHQWSYGRLIQSIQSKAAQIGIVIEEGKQPIRGSPQDKAKELALYAYSLRLARRS

SEQ ID NO: 456 - protein, 645 aa, Calothrix sp. NIES-2100
MSQITIQCRLVASESTRQQLWKLMAELNTPLINELLRQVHQHPEFETWRQKGKHPTSIVKELCQPLKTDPSFIGQPGRFYTSAIATVNYIYKSWFKLMKRSQSQLEGKIRWWEMLKSDAELVEVSGVTLESLRSKADEILAHFTPQSDTVEAQPGKGNKRKKTKKSKVAEGDCAERTLRERSISKTLFEAYRDTEDILTHCAISYLLKNGCKINDKEEDTQKFAKRRRKLEIQIERLREQLEARIPKGRDLTNGKWLETLLLATHNVPESETEAKSWQDSLLKKSSKVPFPIAYETNEDMTWFKNERGRICVKFNGLSEHSFQVYCDSRQLHWFQRFLEDQQIKQNSKNQHSSSLFTLRSGRIAWQEGEGKGEEWKVNHLIFYCSVDTRLWTAEGTNLVRVEKAEEIAKTITQTKAKGELNDQQLAHIKRKNSSLARINNSFPRPSKPLYQGQSHILVAVSLGLEKPATVAVVDGTIGKVLTYRSIRQLLGDNYKLLNRQRQQKHTLSHQRQIAQMLAAPNELGESELGEYIERLLAKEIIAIAQTYKAGSIVLPKLGDMREQVQSEIQAKAEQKSDLIEVQQKYAKQYRVSTHQWSYGRLIENIRSSAAKTGIVIEESKQPIRGSPQEKAKELAIAAYHSRQKT

SEQ ID NO: 457 - protein, 639 aa, Anabaena sp. WA1130
MSQITVQCRLIASESTRQQLWTLMAELNTPLINELLQQLSKHPDFEKWRKDGKFPSTVVSQLCQPLKTDPQFAGQPSRCYLSAIHVVDYIYKSWLTIQKRLQQQLDGKIRWLEMLNSDAELVETSGYSLEAIRTKAAEILAMTTPESDTNVPLTKKRNTKKSKKSSASNPEPSLSHKLFNAYQETDDILSRSAISYLLKNGCKLNDKEEDTEKFAKRRRKVEIQIQRLTDKLTSRIPKGRDLTNSKWLETLFTAITTVPEDNAEAKRWQDILSTRSSSLPFPLIFETNEDLKWSTNEKGRLCVHFNGLTDLTFEVYCDSRQLHWFKRFLEDQQTKRKSKNQHSSGLFTLRNGRLAWQEGEGKGETWQIHRLTLSCCVDNRLWTAEGTEQVRQEKAEDITKFITKMKEKSDLSDTQQAFIQRKQSTLTRINNSFDRPCKPLYQGQSHILVGVSMGLEKPATVAVVDASANKVLTYRSIKQILGENYELLNRQRRQQRSSSHERHKAQKSFSPNQFGTSELGQYIDRLLAKEIVAIAQTYKAGSIVLPKLGDMRENIQSEIQAIAEIKCPGSVEIQQKYAKQYRINVHKWSYGRLIQSIQSKAAQVGIVIEEGKQPVRDSPQDKAKELALSTYHLRLAKQS

SEQ ID NO: 458 - protein, 635 aa, Anabaena cylindrica
MSQITIQCRLVASETTRQQLWQLMAEKNTPLINELLSQIGKHPEFETWRQKGKHPTGIVKELCEPLKTDPRFIGQPARFYTSATASVNYIYESWFALMKRYQSQLDGKLRWLEMFNSDAELVEHSGVSLDTLRATSAEILAQFAPQDTNRDTSNKGKKSKMGKKSQKSDSEGNLSKKLFDAYSSAEDNLTRCAISHLLKNGCKVSNKEENSEKFTQRRRKLEIQIQRLTEKLAARIPKGRDLTDTQWLETLFTATYNVPEDETEAKLWQNSLLRKFSSLPFPVAYETNEDLVWSKNRFGRICLTFPTLREHIFQIYCDSRQLHWFQRFLEDQEIKKNSKNQHSSALFTLRSGRIAWQEGEGKGEPWDIHHLTLYCCVDTRLWTEEGTNLVKEEKAEEIAKTITQTKAKGDLNDKQQAHLKRKNSSLARINNPFPRPSQPLYKGQSHILLGVSLGLEKPATVAVVDGTTGKVLTYRNIKQLLGDNYKLLNRQRQQKHLLSHQRHIAQRIAAPNNFGDSELGEYIDRLLAKEIIAIAQTYQAGSIVLPNLGDMREQIQSEIKAKAEQKSDLVEVQKKYAKQYPNSVHQWSYGRLITNIQSQSKKAGIVIEEGKQQIRASPLEKAKELAINAYQSRKA

SEQ ID NO: 459 - protein, 642 aa, Trichormus variabilis; identical to SEQ ID NO: 444

SEQ ID NO: 460 - protein, 639 aa, Nostoc punctiforme; identical to SEQ ID NO: 447

SEQ ID NO: 461 - protein, 645 aa, Nostoc linckia
MSQITIQCRLVGSESTRQQLWKLMAEKNTPLINELLLKVAQQPEFESWRQKGKHPAKIVKELCEPLKTDPRFIGQPGRFYTSAIALVNYIYKSWLALMKRSQSQLEGKMRWLEMLKSDAELVEASGVTLENLRTKAAEILAQLAPQSDTVEAKSPKGNKRKKTKKSKKSDGDCAERTLRERSISQILFEAYRNTEETLTRCAIGYLLKNGCKISNQDEDADKFAKRRRKLEIQIERLKQQLEARIPKGRDLTDAKWLETLLLVTNNAPENEAEAKFWQDSLLKQSSKLPFPVAYETNEDMTWFKNERGRICVKFNGLSEHSFQVYCDSRHLHWFQRFLEDQQIKHNSKNQHSSSLFTLRSGRIAWQEGEGKGDHWKVNRLILYCSVDTRLWTAEGTNLIREEKAEEIAKTITQTKAKGELNDQQLAHIKRKNSSLARINNPFPRPSKPLYKGQSHILVAVSLGLENPTTVAVVDSSIGKVLTYRSIKQLLGDNYRLLNRQRQQKHTLSHQRQVAQILASPNQIGESELGQYVDRLLAQEIVAIAITYKAGSIVLPKLGDMREQVQSEVQAKAEQKSDLIEVQQKYAKQYRVSVHQWSYGRLIANIESQSAKAGIFIEEAKQPIRGSPQEKAKELAIAAYDSRKIN

SEQ ID NO: 462 - protein, 614 aa, Crinalium epipsammum
MSQITVQCRLVASESTRHHLWKLMADLNTPLINELLARMAQHQDFETWRKKGKLPDGIVKQLYQPLKTDPRFTNQPGRFYTSAITVVDYIYKSWFKIQQRLEQKLKGQIRWLGMLKSDEELAAESNTSIEVIRTNAAELITSLSSEDGSVSTRLWKTYDETDDILTHCVICYLLKNGSKVPKKPEENLEKFAKRRRKVEIKIERLRRQLESRIPKGRDLTGKNWLETLAIASTTAPADEPEAQSWQDTLLTESKLVPFPVAYETNENLTWSKNEKGRLCVQISGLSKHIFQIYCDQRQLKWFQRFYEDQEIKKANKDQYSSGLFTLRSGRIAWQEGTDKGEPWNIHHLILYCTVDTRLWTAEGTEQVCQEKAEDIAKTLTRMKKKGDLNDRQQAFIRRQQSTLARLNNPYPRPSQPLYQGQPHILVGLAFGLDKPATAAVVDGTTGKAITYRSLKQLLGDNYELLNKQRKRKQQQSHQRHKAQSNGRSNQFGDSDLGEYVDRLLAKALVTLAQSYQAGSIVLPKLGDIRELIQSEIQAKAEQKIPGYIAGQEKYAKQYKISVHQWSYGRLIDNIKAQAAKISIVIEEGQQPIRGSPQEKAKEMAISAYDDRTKS

SEQ ID NO: 463 - protein, 632 aa, Cuspidothrix issatschenkoi
MSQITIQCRLLASESTRQQLWQLMAEKNTPLINELLMQMGKHPEFETWRQKGKHPTGVVKELCEPLKTDPRFMGQPARFYTSATASVNYIYKSWFALMKRFQSQLDGKLRWLEMLNSDTELEAASGVSLDVLQTKSAEILAQFAAQNPAETQPAKGKKGKKSPTSDSERNLSKNLFDAYSNTEDNLTRCAISYLLKNGCKISNKAENTDKFAQRRRKVEIQIQRLTEKLAARIPKGRDLTDTLRLETLFNATQTVPENETEAKLWQNILLRKSSQVPFPVAYETNEDLVWFKNQFGRICVKFSGLSEHTFQIYCDSRQLHWFQRFLEDQQIKKDSKNQHSSALFTLRSGRISWQEGQGKGEPWNIHHLTLYCSVDTRLWTEEGTNLVKEEKAEEIAKTITQTKTKGDLNDKQQAHLKRKSSSLARINNHFPRPSQPLYKGLSHILVGVSLGLENPATIAVVDGTTGKVLTYRNIKQLLGESYKLLNRQRQQKHLLSHERHVAQRMSAPNQFGDSELGEYIDRLLAKEIIAVAQTYKAGSIVIPKLGDMREQIQSEIQSKAEQKSDIIEVQQKYAKQYRTTVHQWSYGRLISNIQSQASKAGIAIEEGKQPIRASPLEKAKELAISAYQSRKA

SEQ ID NO: 464 - protein, 632 aa, Anabaena sp. WA102
MSQITIQCRLVASESTRQQLWQLTAEKNTPLINELLSQIGKHPEFETWRQQGKHPTGIVKELCEPLKTDPRFIGQPARFYTSATASVNYIYKSWFALMKRFQSQLDGKLRWLEMLNSDTELVEASGVSLDILQTKSAEILAQFAPQNPAETQPAKGKKGKKSPNSDSDRNLSKNLFDGYSNTEDNLTRCAISYLLKNGCKISNKAENTDKFAQRRHKVEIQIQRLTEKLAARIPKGRDLTDTIRLETLFNATQTVPENETEAKFWQNILLRKSSQVPFPVAYETNEDMTWLKNQFGRICVKFNGLSEHTFQIYCDSRQLHWFQRFLEDQQIKKDSKNQHSSALFTLRSGRISWQEEEDKGEPWDVNHLTLYCSVYTRLWTEEGTNLVKEEKAEEIAKTITQTKAKGDLNDKQQAHLKRKNSSLARINNPFPRPSQPLYKGQSHILVGVSLGLENPATIAVVDGTTGKVLTYRNIKQLLGENYKLLNRQQQQKHLLCHQRHIAQRMSAPNQFGDSELGEYIDRLLAKEIIALAQTYKAGSIVIPKLGDMREQIQSEIQSKAEQKSDIIEVQKKYAKQYRVSVHQWSYGRLIANIQSQANKAGIAIEEGKQPIRASPQEKAKELAISAYQSRKA

SEQ ID NO: 465 - protein, 635 aa, Nostoc sp. MBR 210
MSVITIQCRLVAEEDTLRKLWELMAGKNTPLVNELLAQVGKHPEFETWLEKGKIPTEFLRTLVNSLKTQERFADQPGRFYTSAIALVDYVYKSWFALQKRRKYQIEGKERWLKILKTDLELEQESQCSLNLIRTTANEILTKLTPQSEQNKNQRKGKKTKKSTKPKKPSLFQILLNTYKETEDPLTRCAIAYLLKNNCQISELDEDSEEFTKNRRKKEIEIERLKNQLQSRIPKGRDLTGEEWLKTLEISTANVPQNENEAKAWQAALLRKSADVPFPVAYESNEDMTWLQNDKGRLFVRFNGLGKLTFEIYCDKRHLHYFKRFLEDQELKSNSKNQYSSSLFTLRSGRLAWSPGEEKGEPWKVNQLHLYCALDTRMWTIEGTQQVVDEKSTKITETLTKATQKDELNDKQQAFITRQQSTLDRINNPFPRPSKPNYQGQPSILVGVSFGLEKPVTIAVVDVVKNEVLAYRSVKQLLGKNYNLLNRQRQQQQRLSHERHKAQKKNAPNSFGESELGQYVDRLLADGIVAIAKTYQASSIVIPKLRDMREQISSEIQSRAEKKCPGYKEAQQKYAKEYRMSVHRWSYGRLIESIKSQAAKDGISTEIGTQPIRGSPQEKARDLAVFAYQQRQVAVI

SEQ ID NO: 466 - protein, 632 aa, Anabaena sp. 4-3
MSVITIQCRLVAEEDTLRTLWELMADKNTPLINEILAQVGKHPEFETWLEKGKIPTELLKTLVNSLKTQERFASQPGRFYTSAIALVDYVYKSWFALQKRRKRQIEGKERWLTILKSDLELEQESQCSLNIIRTKATEIITEFTPQSDQNNSQKKRKKTTKSTKPSLFQILLNNYEETQDILTRCALAYLLKNNCQISERDENPEEFTRNRRKKEIEIERLKDQLQSRIPKGRDLTGEEWLKTLEVVRANVTQNENEAKAWQAAILRKSADVPFPVAYESNEDMTWLQNDKGRLFVRFNGLGKLTFEIYCDKRHLHYFKRFLEDQELKRNSKNQYSSSLFTLRSGRLAWSPGEEKGEPWKVNQLHLYCTLDTRMWTIEGTQQVVDEKSTKITETLTKAKQKDDLNDKQQAFVTRQQSTLNRINNLFPRPSKSRYQGQPSILVGVSFGLENPVTLAVVDVVKNEVLAYRSVKQLLGKNYNLLNRQRQQQQRLSHKRHKAQKRNAPNSFGESELGQYVDRLLADAIIAIAKTYQAGSIVIPKLRDMREQISSEIQSRAEKKFPGYKEAQQKYAKEYRMSVHRWSYGRLIESIKSQAAKAGISTEIGTQPIRGSPQEKARDLAVFAYQERQAALI

SEQ ID NO: 467 - protein, 635 aa, Trichormus variabilis
MSVITIQCRLVAEEDILRQLWELMAEKNTPLINELLAQVGKHPEFETWLDKGRIPTELLKTLVNSFKTQERFADQPGRFYTSAIALVDYVYKSWFALQKRRKRQIEGKERWLTILKSDLQLEQESQCNLNVIRTKANEILTQFTPQSDQNKNPRKSKKAKKSAKLQKSSLFQILLNTHEQTQETLTRCAIAYLLKNNCQISERDEDPEEFNRNRRTKEIEIERLKDQLQSRIPKGRDLTGEEWLETLEIATVNVPQNEKEAKAWQAALLRKTADVPFPVAYESNEDMTWLQNDKDRLFVRFNGLGKMTFEVYCDKRHLHYFKRFLEDQEIKRNSKNQYSSSLFTLRSGRLAWLPGKQKGEPWKINQLHLYCTLDTRMWTAEGTQQVVNEKITKITETLTKAKQKDELNDKQQAFITRQQSTLDRINNPFPRPSQPNYQGRPSILVGVSFGLEKPVTLAVVDVVKNEVLAYRSVKQLLGKNYNLLNRQRQQQQRLSHERHKAQKQNAPNSFGESELGQYVDRLLADEIVAIAKTYQAGSIVIPKLRDMREQISSEIQSRAEKKCPGYKEVQQKYAKEYRMSVHRWSYGRLIESIKSQAAKAGIFTEIGTQPIRGSPQEKARDLAVFAYQERQAALI

SEQ ID NO: 468 - protein, 638 aa, Chlorogloea sp. CCALA 695
MSQSTVQCRLIASTSTRQQLWKLMAQLNTPLINEILQQLNKHPDFEKWRKNGKLPSTVVSQLCHPLKTDLRFVGQPSRLYTSAIHVVDYIYKSWLAIHKRLQQQLDGKIRWLEMLNSDAELVETSFCSLEEIRTKAADILAMTTPESDANAPLIERRKTKKSKKSSTSNSDRGLSHKLFDAYQNTEDRLRRSAISYLLKNGCKLKDKEDPEQFAKRRRKLEIQIQRLTEKLTSRIPKGRDLANAKWLETLFTATTTVPEDNAEAKRWQDILLTRSSLLPFPLVFETNEDLVWSTNEKGRLCVHFNGLSDLTFEVYCDSRQLHWFKRFLEDQQTKRKSKNQHSSGLFTLRNGRLAWLEGKGKGEPWELHHLTLYCCVDTRLWTTEGTEQVRQEKTNEITKFITKMKEKTDLSVTQQAFVQRKQSTLTRINNSFERPNKPVYQGQSNILVGVSLGLEKPATVAVVDALTNKVLACRSTRQLLNENYELLNRQRRQQQSLSHERHKAQKSFSPNQLGASELGQYVDRLLAKEIVAIAQSYFAGSIVLPKLGDMREIIQCEIQAIAEAKCPGSKEIQKNYAKQYRVNVHQWSYGRLLQNIQSKATQMGIVIEEGKQPVRGSPQDKAQELALSAYKLRLARQS

SEQ ID NO: 469 - protein, 635 aa, Nostoc sp. NIES-3756
MSVITIQCRLVAEEDTLRQVWELMTDKNTPLVNELLAQVGKHPEFETWLEKGKIPTEFLKTLVNSLKNQERFSDQPGRFYTSAIALVDYVYKSWFALQKRRKRQIEGKERWLIILKSDLQLEQESQCSLNVIRTEANEILAKFTPQSDQNKNQRKSKRTRKSAKLQTPSLFQNLLNTYEQTQETLTRCAIAYLLKNNCQISERDEDPEEFNRNRRKKEIEIERLKDQLQSRIPKGRDLTGEEWLKTLEIATTNVPQNENEAKAWQAALLRKPADVPFPVAYESNEDMTWLQNDKGRLFVRFNGLGKLTFEIYCDKRHLHYFKRFLEDQELKRNSKNQHSSSLFTLRSGRIAWSLGEEKGEPWKVNKLHLYCTLDTRMWTIEGTQQVVSEKTTKITETLNQAKRKDVLNDKQQAFVTRQQSTLDRINNPFPRPSKPNYQGQPSILVGVSFGLEKPVTLAVVDVIKNEVLAYRTVKQLLGKNYNLLNRQRQQQQRLSHERHKVQKRNAPNSFGESELGQYVDRLLADAIIAIAKTYQAGSIVIPKLRDMREQISSEIQSRAEKKCPGYKEVQQKYAKEYRMSVHRWGYGRLIESIKSQAAKAGIFTEIGTQPIRGSPQEKARDLAVFAYQERQAALI

SEQ ID NO: 470 - protein, 635 aa, Nostoc piscinale
MSVITIQCRLVAGEDTLRTLWELMADKNTPLVNELLAQVGKHPEFEPWLEKGKIPTEFLKTLVNSLKTQERFADQPGRFYTSAIALVDYVYKSWFALQKRRKRQIEGKERWLTILKSDLQLEQESQCSLNAIRTKANEILTKLTPQSEQNKNQRKSKKTKKSAKLQKSSLFQILLNTYEQTQETLTHCAIAYLLKNNCQISELEEDSEEFTKNRRKKEIEIERLKDQLQSRIPKGRDLKGEEWLKTLEISTANVPQNENDAKAWQAALLRKSADVPFPVAYESNEDMTWLQNEKGRLFVRFNGLGKLTFEIYCDKRHLHYFTRFLEDQEIKRNSKNQYSSSLFTLRSGRLAWSPGEDRGEPWKVNQLHLYCSLDTRMWTIEGTQQVADEKSTKITETLTKAKQKDELNDKQQAFITRQQSTLDRINNPFPRPSKPNYQGQPSILVGVSFGLEKPVTVAVVDVIKNEVLAYRSVKQLLGKNYNLLNRQRQQQQRLSHERHKAQKRNAPNSFGESELGQYVDRLLADAILAIAKTYQASSIVIPKLRDMREQITSEIQSRAEKKCPGNKEVQKKYAKEYRMSVHRWSYGRLIESIKSQAAKTGIFTEIGTQPIRGSPQEKARDLTVFAYQERQASVI

SEQ ID NO: 471 - protein, 639 aa, Scytonema hofmanni
MSQITIQARLISFESNRQQLWKLMADLNTPLINELLCQLGQHPDFEKWQQKGKLPSTVVSQLCQPLKTDPRFAGQPSRLYMSAIHIVDYIYKSWLAIQKRLQQQLDGKTRWLEMLNSDAELVELSGDTLEAIRVKAAEILAIAMPASESDSASPKGKKGKKEKKPSSSSPKRSLSKTLFDAYQETEDIKSRSAISYLLKNGCKLTDKEEDSEKFAKRRRQVEIQIQRLTEKLISRMPKGRDLTNAKWLETLLTATTTVAEDNAQAKRWQDILLTRSSSLPFPLVFETNEDMVWSKNQKGRLCVHFNGLSDLIFEVYCGNRQLHWFQRFLEDQQTKRKSKNQHSSGLFTLRNGHLVWLEGEGKGEPWNLHHLTLYCCVDNRLWTEEGTEIVRQEKADEITKFITNMKKKSDLSDTQQALIQRKQSTLTRINNSFERPSQPLYQGQSHILVGVSLGLEKPATVAVVDAIANKVLAYRSIKQLLGDNYELLNRQRRQQQYLSHERHKAQKNFSPNQFGASELGQHIDRLLAKAIVALARTYKAGSIVLPKLGDMREVVQSEIQAIAEQKFPGYIEGQQKYAKQYRVNVHRWSYGRLIQSIQSKAAQTGIVIEEGKQPIRGSPHDKAKELALSAYNLRLTRRS

SEQ ID NO: 472 - protein, 638 aa, Mastigocoleus testarum
MTQITVQCRLVATETTRQELWDLMADKNTPLINELLKQVAEHSDFEAWRQKGKIPTGTIKQLCEPLKTDSRFIGQPGRFYTSAIALVSYIYKSWLALMKRLQYKLEGKIHWLEMLKSDEELVEISGVNLEALRSKAAEILAQFSPQIDTNNSQNKRKTKSKNSKKSKSSDISKNLSQQLFDTYRDTEDIVTHCAISYLLKNGSKLPNKEESPEKFTQRRRKIEIQIQRLREQLEARIPHGRDLTDLNWLNTLDIATNQVPQSETEAKSWQNNLLRKSHAVPFPVSYETNEDMTWFKNRKGRICVKFNGLSEHTFEIYCDNRQLHWFKRFLSDQQIKKNSKNQHSSSLFTLRSGRISWQEEVGKDRPWNVNHLKLDCTVDTRLWTAEGTNQVREEKAEEIAKTITKSKEKGELNDRQLAHIKRKQSTLDRINNPYPRPNKPLYKGLSNILVGVSLGLEKTATVAILDASTDKVVTYRSIKQLLGENYKLLNRQRQQKGELSHQRKIAQTQAASNQYGESELGQYIDRLLAKEIVAIAQKYSAGSIVLPKLSDMREQINSEIQAKALEKCPDCIEAQKKYAKQYRRSVNQWSYGRLIENIKSQAIKTGIVIEESKQPIRGSSQDKAKELATTAYKSRKKS

SEQ ID NO: 473 - protein, 635 aa, Nostoc sp. NIES-4103
MSVITIQCRLVAEEETLSQLWELMADKNTPLINELLAQVGKHPDFETWLEQGKIPTELLKTLVNSLKTQERFAGQPGRFYTSAIAIVDYVYKSWFALQKRRKHQIEGKERWLTILKSDQQLEQESQCSLNVIRTKAIEILSQFTPQSDQNKNQRKSKKTKKSAKLHKSSLFQILLNTYEQTQDPLTRCAVAYLLKNNCQISELHEDPEKFTRNRRKKEIEIERLKDQLQGRLPKGRDLTGEEWLETLEIATDNVPQNENEAKAWQAALLRKSAEVPFPVAYESNEDMTWLKNDKGRLFVRFNGLGKLTFEIYCDKRHLHYFQRFLEDQEIKRNSKNQYSSSLFTLRSGRLAWLPGEEKGEPWKVNQLHLYCALDTRMWTTEGTQKVINEKSIKITETLTKAKQKEDLNDKQQAFITRQQSTLDRIHNPFPRPSKPNYQGQPSILVGVSFGLEKPVTVAVVDVVKNEVLAYRSVKQLLGKNYNLLNRQRQQQQRLSHERHKAQKQNAPNSFGESELGQYVDRLLADAIVAIAKSYQAGGIVIPKLHDMREQISSEIQSRAENKCPGYKEAQQKYAKEYRMSVHRWSYGRLIDSIKSQAAKVGISTEIGTQPIRGSPQEKARDLAVFTYQERQAALI

SEQ ID NO: 474 - protein, 635 aa, Nostoc sp. CENA543
MSIITIQCRLVAEEETLRKLWELMTDKNTPLINELLAQVGQHPDFENWLEKGKIPTELLKTLVNSLKTQERFSGQPGRFYTSAIALVDYVYKSWFALQKRKKRQIEGKERWLTILKSDLQLEQESQCSLNAIRTKANEILTKLTPQSEQNKNQRKSKRTKKSAKLQKSSLFQILLNTYEETQDALTRCAIAYLLKNNCQISELDEDLEAFTRHKRKKEIEIQRLKDQLQSRIPKGRDLTGEEWFKILEIATGNVPQNENEAKAWQAALLRKSADVPFPVAYGSGEDMTWLQNDKGRLFVRFNGLGKLTFEIYCDKRHLHYFKRFLEDQEIKRNSKDEYSSSLFTLRSGRLVWLPREKKGEAWKVNQLNLFCALDTRTLTNEGTQQVILEKSAKITKKLTKAKQKDDLNDKQQAFITRQQSTLDMINNPFPRPTKPNYQGQPSISVGVSLGLEKPVTLAVVDVVKNEVLAYRSVKQLLGKNYNLLNRQRQQQQRLSHERHKAQKRNAPNSFGESELGQYVDRLLADGIVAIAKTYQASSIVIPKLRDMREQISSEIQSRAEKKCPGYKEAQQKYAKEYRMSVHRWSYGRLIESIKSQASKAGISTEIGTQPIRGSPQEKARDLAVFAYQERQAALI

SEQ ID NO: 475 - protein, 636 aa, Nostoc sp. HK-01
MSIITIQCRLVAEEETLRQLWELMTDKNTPLVNELLAQVGKHPDFETWLEKGKIPTELLKTLVNSLKTQERFVGQPGRFYTSAIALVDYVYKSWFALQKRRKRQIEGKERWLTILKSDIQIEQESQSTLNVIRTKATEILTKFTPQSEQNHNQRKSKRTKKKSTNSKKSSLFQILLNTYEETQDTLTRCALAYLLKNNCQISELDEDPEEFTRKKRKKEIEIQRLKDQLQSRIPKGRDLTGEEWLETLELARANVPQNEKEAKAWQAALLRKSADVPFPVAYESNEDMTWWQNDKGRLFVRFNGLGKLTFEIYCDKRHLHYFKRFLEDQEIKRNSKNQYSSSLFTLRSGRLSWRPGEEKGEPWKVNQLHLHCALATRMWTTEGTQQVVNEKTTKITKTLTQAKQKNELNEKQQAFITRQQSTLDRINNPFPRPSKANYQGQSSILVGVSFGLEKPVTIAVVDVVKNEVLAYRSVKQLLGKNYNLLNRQRQQQQRLSHERHKAQKQNVPNSFGESELGQYVDRLLADAIIAIAKTYQAGSIVIPKLRDMREQISSEIQSKAEKKCPGYKEAQQKYAKEYRMTIHRWSYGRLIESIKSQAAKAGIPTEIGTQPIRGSPQEKARDLAVLAYQERQVAVI

SEQ ID NO: 476 - protein, 633 aa, Nostoc sp. 'Peltigera malacea cyanobiont' DB3992
MSVITIQCRLVAEEDTLRQLWELMAEKNTPLINELLLQVGKHPEFETWLEEGKIPTELLKTLVNSLKTQERFAGQSGRFYTSAIALVDYVYKSWFALQKRRKYQIEGKERWLKMLKSDLELEQESQCSLNVIRTKATEILTKFTPQSEQNSKQKKGKKTKKSTKSKKSSLFQILLNTYGETEDPLTRCALAYMLKNKCKISEIDEDPEEFTRNRRKKEIEIERLKDQLQSRIPKGRDLTGEEWLETLEIVTANVAQNEKEAKTWQAALLRKTADVPFPVAYESNEDMTWLKNDKGRLFVRFNGLGKLTFEIYCDKRHLQYFQRFLEDQEIKRNSKNQHSSSLFTLRSARLAWLPGEEKGEVWKVNQLNLYCSLDTRMWTTEGTQQVVEEKVTRITNTLTKVKQKDDLKDKQQAFITRQQSTLDRINNPFPRPSKPNYQGQPSILVGVSFGLKKPVTVAVVDVVKNEVLAYRSVKQLLGENYNLLNRQRQQQQRLSHERHKAQKQNAPTSFGESELGQYVDRLLADAIIVIAKTYQADSIVIPKLRDMREQISSEIQSRAEKKCPGYKEAQQKYAKEYRISIHRWSYGRLIESIKSQAAKVGISTEIGTQPIKGSPQEKAGNLAVFAYQERQAA

SEQ ID NO: 477 - protein, 627 aa, Spirulina major
MSQITIQCRLVASEATRQVLWTLMAERNTPLINELLAQMAQHPDLEEWRQKGKPTPGVVKKLCDPLRQDPRFMGQPGRFYSSAIALVEYIYKSWLKLQQRLQRKLEGQQRWLGMLKSDPELCEENHCTLDTLRDKAAEILASLESPQPKQGKVKTKKAKAQSSPRQSLFEMHDGAEDGFVKSAIAYLLKNGGKLPTHEEDPKKFAKRRRKAEVKVERLIHQITASLPKGRDLTGERWLETLLTASYTAPKDAQQTKVWQSILLTKTKAVPYPINYETNEDLTWSKNEKGRLCVRFNGLSEHTFQIYCDQRQLKWFQRFYEDQEVKRTSKNQHSTSLFTLRSGRIVWQESDRNDKPWTANHITLCCTLDTRLWSAEGTEEVRTEKAIDIAKTLTNMNEKGDLNDKQQAFIKRKTATLDRINNPYPRPSKPLYHGQSHILVGVALGLDKPATVAVVDGTTGKAITYRNLKQLLGENYKLVNRQRQQKQAQSHQRHKAQKRSGTDQFGDSELGQHIDRLLAKAIVAFAHSQSAGSIVVPKLEDIREIVQSEIQARAEEKVPGYIEGQKQYAKRYRVQVHQWSYGRLIDSIKSKATQQQVVIEEGKQPVRGSPEAQATELAISTYHLRASS

SEQ ID NO: 478 - protein, 635 aa, Nostoc sp. PCC 7107
MSVITIQCRLVAEEDILRQLWELMADKNTPLINELLAQVGKHPEFETWLDKGRIPTKLLKTLVNSFKTQERFADQPGRFYTSAIALVDYVYKSWFALQKRRKRQIEGKERWLTILKSDLQLEQESQCSLSAIRTKANEILTQFTPQSEQNKNQRKGKKTKKSTKSEKSSLFQILLNTYEQTQNPLTRCAIAYLLKNNCQISELDEDSEEFTKNRRKKEIEIERLKNQLQSRIPKGRDLTGEEWLKTLEISTANVPQNENEAKAWQAALLRKSADVPFPVAYESNEDMTWLQNDKGRLFVRFNGLGKLTFEIYCDKRHLHYFKRFLEDQELKRNHKNQYSSSLFTLRSGRLAWSPGEEKGEPWKVNQLHLYCTLDTRMWTIEGTQQVVDEKSTKINETLTKAKQKDDLNDQQQAFITRQQSTLDRINNLFPRPSKSRYQGQPSILVGVSFGLKKPVTVAVVDVVKNEVLAYRSVKQLLGENYNLLNRQRQQQQRLSHERHKAQKQNAPNSFGESELGQYIDRLLADAIIAIAKTYQAGSIVLPKLRDMREQISSEIQSRAEKKCPGYKEVQQKYAKEYRMSVHRWSYGRLIECIKSQAAKAGISTEIGTQPIRGSPQEKARDVAVFAYQERQAALI

SEQ ID NO: 479 - protein, 635 aa, Chlorogloea sp. CCALA 695
MSVITIQCRLVAEEDFLRQLWELMAEKNTPLINELLAQLGKHPELETWLEKGKIPTELLKALGNALKTQEPFAGQPGRFYTSAIALVNYVYKSWFALQKRRKYQIEGKERWLKMLKSDLDLEQESQCSLDVIRIKATELLTKFTPQFDTNNKQRKGKKNKKASKTQKPSVFKVLLNTYEETQCLLTRCALAYLLKNNCQISELNENLEEFTRNRRKKEIEIERLKDQLQSRIPKGRDLKGEEWLKILKIATANVAQDENEAKAWQAALLRKTKNVPFPVDYESNEDMTWLKNDKNRLFVRFNGLGKLTFEIYCDKRHLPYFQRFLEDQEIKRNSKNQYSSSLFTLRSARISWLPGKEKGEAWKVNQLNLYCSLDTRMWTTEGTIQVVEEKVMAITETLTKTKQKDDLNHKQQAFITRQQSTLNRITNPFPRPCKPTYQGKPSILLGVSFGLDKPATVAVVDAANKKVLAYRSTKQLLGKNYNLLNRQRQQQQRLSHERHIAQKQNAPNSFGESELGQYVDRLLADAIIAIAKTYQVGNIVLPKLRYMREQISSEIQSRAEKKCPGFKEAQQKYAQEYRISVHRWSYGRLVESIKSQAAKAGISTEIVTLLTRGSPEEKARDLAVFAYQERQAALI

SEQ ID NO: 480 - protein, 670 aa, Cyanothece sp. PCC 8802
MSTITIQCRLVAPEATRQALWQLMAQKNTPLVSELLRQVAQHPDFETWRQQGKLEAGIIKKLCEPLKKDPRFYEQPARFYTSAISLVDYIYKSWLKVQRRLQNKLEGQNRWLVMLKSDEELVQISQSSLETIQAKATDILSTLKPEKPDKFPETSTTKGKKSKKYKNNNSLFTQLYNLYEKADDTLTHCAIRYLLKNGCKIPQKPEDPEKFAQRRRKVEIKIERIIEQIESSIPQGRDLTGDSWLETLIIAANTATVEASEIKSWQDKLLSQSKSIPYPVAYETNEDLTWSINEKGRLCVRFNGLGKHTFQIYCDQRQLKWFQRFYEDQQIKKDGKDHHSSALFSLRSGRIVWQEGLGKGKPWNIHRLTLHCSLDTRFWTEEGTQQVQQEKSKKFQTNRLRMKPELTFSIFFRSQTLETYLQVWLVITAYRLQSFLDKGNVAKAHQEFQKAIKRNESSLQKITSSYNRPHKTLYQGKSHIFVGVAMGLEKPATVAVVDGTTGKAIAYRSLKQLLGNNYHLFNRQGKQKQNTSHQRHKSQKHFADNQFGESQLGQYIDCLLAKAIISVAQTYCAGSIVVPKLKDMRELIQSEIQAKAEAKIPGYVEGQAKYAKSYRVQVHQWSHGRLIDNITSQASKFNITVEEGEQPHQGNPQDKAKLLAIAAYHSRLCA

SEQ ID NO: 481 - protein, 615 aa, Myxosarcina sp. GI1
MSQNAIQCRLIAPETTRRQQWQLMAEKNTPLINELLKQLAEHPELETWKRKGKIPPGTVKNLCQPLRTCPQYINQPGRFYSSVISLAEYIYRSWLKLQRRLIFRLNGQQRWLQMLKSDEELVAESGRSLKEIEAKASEALDRLNREENPSISNRLFDLYDETEDILIRSAIVYLLKNGCKIRQKPEDPKKFARRRRKTEIRVKRLQEKLNGKAPQGRDLTGEKWLNTLFTATSQVPQDEAQAKSWQDILLTKSKLVPYPIVYESNEDLTWSKNERGRLCVKFNGLSDHTFQIYCDRRQLKIFNRFYEDQQIKKASKNSHSSALFTLRSATIAWQEGKGKGEPWNVNRLILYCTFDNLLLTTEGTEVVRQEKAEAIANTLTKIKEKGDLNQKQQAFIRRKETSLSRINNPFPRPSRPLYKGKSNILLGVAIRLDKPATVAIVDGATDKAIAYLSTKQLLGKNYHLLNRKRQQQHILSHQRNVAQRHHANNKFGESELGQYIDRLLAKAIIQLAKDYRVGSIVVPYMEDTREIIQAEVQARAEAKIPGCIEKQKEYAKKYRTNIHKWSYGRLIDLIKAQAAKAGIVIEESKQSIRGDPKKQAKEIAVCAYRDRIVPF

SEQ ID NO: 482 - protein, 642 aa, Aphanizomenon flos-aquae
MSVITIQCRLVAEEDSLRQLWELMTEKNTPFINEILLHLGKHPEFETWLEKGRIPAESLKTLGNSLKTQEPFTGQPGRFYTSAIALVDYLYKSWFALQKRRKNQIEGKQRWLKMLKSDPELEQESQSSLEVIRTKATELFSKFTPQSDSEALRRNQNDKSKKGKKTKKPTKAKTSSIFKILLNTYEEAEDPLTRCALAYLLKNNCQISELDENPEEFTRNKRRKEIEIERLKDQLQSRIPKGRDLTGEQWLETLEIATVKVPQNENEAKAWQAALLRKTANVPFPVAYESNEDMTWLKNDKNRLFVRFNGLGKLNFEIYCDKRHLHYFQRFLEDQEILRSSKRQHSSSLFTLRSGRIAWLPGEEKGEHWKVNQLNFYCSLDTRMLTTEGTQQVVEEKVTAITEILTKTKQKDDLNDKQQAFITRQQSTLSRINNPFPRPSKPNYQGKSSILIGVSFGLEKPVTVAVVDVVKNQVIAYRSVKQLLGENYNLLNRQRQQQQRLSHERHKAQKQNAPNSFGESELGQYVDRLLADAIIAIAKKYQAGSIVLPKLRDMREQISSEIQSRAENQCPGYKEGQQKYAKEYRINVHRWSYGRLIESIKSQAAQAGIAIETGTQPIRASPQEKARDLALFAYQERQAALI

SEQ ID NO: 483 - protein, 616 aa, Xenococcus sp. PCC 7305
MSNITIQCRLIAPEETRRQLWQMMVEKNTPLINELLRLLAEHPDLETWKRRGNTPPGTVKNLCLPLRTDPQFVGQPGRFYSSAISLVEYIYKSWLKLQQRWEFQLQGQERWISMLKSDEELEVYCDHTLEDIKLKATQILDNDLTEENRGISNQLFSLYDETEDTFTRNAIAYLLKNGCKIRQKPEDPKKLAKRRRKTEIKIARLTEKLNGKAPQGRDLTGQTWLDTLLTATTQVPQDEAQAKSWQDKLLTEPKSVPYPIAYESNGDLTWSKNEKDRLCVKFNGLGKHIFQIYCDKRQLTVFQRFYEDQEIKKASKNNHSSALFALRSARIFWQERKGKGKSWDVNRLILRCTFETLLLNAEGTELIRQEKANAIAKTLTDIKEKGDLNQKQQAFVKRKQTSLDRINNPFPRSSKPLYRGKSNVLLGISMRLDNPATAAIVDGETGKVIVYQSTKQLLGKKNYHLLNRQRQQKQLLSRKRNVAQRHNANNKFGESELGQYLDRLLAKAIIKLAKDYQAGSIVVPQVGDIRDIIHTEVQARAESKIPGCIEKQKEYAKKYRTNAHSWSYGRLIENIKSQASKAGILVEESKQPIRGSPNEQAKEIALYAYCDRSESY

SEQ ID NO: 484 - protein, 655 aa, Halothece sp. PCC 7418
MSQITIQCRLVASAETRQHVWELMAEQNTPLVNELLKQVAEHPEFETWQQKGKLPAGIVSKLCKPLKEDSRFSGQPGRFYTSATKLVEYIYQSWLALQKRLQWRLNGQKRWLEILKSDQELCQQADCSLETLCHKASEILASFQSSTTKSKKKSKKQKNSSRKSLFDAYDSAEDSLTRSAIAYLLKNNCKIPEQQEDPEKFTQRRRKAEIKVERLTRQIDSSLPKGRDLTGERWLETLITAANKVPQNIEEFKSWQNILLTKPKSVPFPISYETNEDLTWSKNEKGRLCVRFSGLSDHTLQIYCDQRQLKWFQRFYEDQETKRASKNQHSSSLFTLRSARILWQEGTAKGQAWHRNYLSLYCTVDTRLWTAEGTEQVRQEKTDEITKILTNMEEKGDLSQTQEAFIKRKQTTLDRLNNSYPRPSKPLYQGQSHLLLGIAFGLEKPATIAIVDGTTGKAITYRSIKQLLGENYKLLNRHRKQKQVQSHQRHKNQKKFAPNQLRNSELGEYIDHLIAKAIVNIAQKYKVGSIVLPKLDNIREVIQSEVQMRAEQKIPGVVEKQKEYAKQHRIQVHQWSYNRLIESIKAKANQKEIVIEQAKQPNRIQVHQWSYNRLIESIKAKANQKEIVIEQAKQPIRDSSQEEAKELATIAYKSR

SEQ ID NO: 485 - protein, 642 aa, Anabaena cylindrica
MSVITIQCRLVAEEDSLRQLWELMSEKNTPFINEILLQIGKHPEFETWLEKGRIPAELLKTLGNSLKTQEPFTGQPGRFYTSAITLVDYLYKSWFALQKRRKQQIEGKQRWLKMLKSDQELEQESQSSLEVIRNKATELFSKFTPQSDSEALRRNQNDKQKKVKKTKKSTKPKTSSIFKIFLSTYEEAEEPLTRCALAYLLKNNCQISELDENPEEFTRNKRRKEIEIERLKDQLQSRIPKGRDLTGEEWLETLEIATFNVPQNENEAKAWQAALLRKTANVPFPVAYESNEDMTWLKNDKNRLFVRFNGLGKLTFEIYCDKRHLHYFQRFLEDQEILRNSKRQHSSSLFTLRSGRIAWLPGEEKGEHWKVNQLNFYCSLDTRMLTTEGTQQVVEEKVTAITEILNKTKQKDDLNDKQQAFITRQQSTLARINNPFPRPSKPNYQGKSSILIGVSFGLEKPVTVAVVDVVKNKVIAYRSVKQLLGENYNLLNRQRQQQQRLSHERHKAQKQNAPNSFGESELGQYVDRLLADAIIAIAKKYQAGSIVLPKLRDMREQISSEIQSRAENQCPGYKEGQQKYAKEYRINVHRWSYGRLIESIKSQAAQAGIAIETGKQSIRGSPQEKARDLAVFTYQERQAALI

SEQ ID NO: 486 - protein, 649 aa, Calothrix sp. PCC 7103
MSIITIQCRLVANDRTLQHLWELMAEKNTPLISELLEQLGKHPDFETWLKNGKVPKDTIKILCDSLKTQSRFAGQPGRFYTSAISQVKEIYKSWLTLQKRRQRQIEGKQRWLGMLKSDVELQEESNCSLEKIRAKGTEILAEFVSKFTKDTTKKSKTKIKSTKKSNKKTKKDTEESNSTLFQALCDIYDKTEDTLSKCAIIYLLKNNCQVIDTEENPDTFLKRKRAKEIEIKRLQDQIVGRIPKGRDLTDKKWLDTIKLASSQVPQDENEAKSWQNQLLKTSSSVPYSVDYETNTDIKWVKHNNGSIFVNFNGLGEHQFEVYCDSRQLPYFQRFCEDMQIWHNDEEKYSSALFMLRSARLVWLEKKGRGKPWNVNYLYLHCSLDTSLWTAEGTEQIRINKINETDEAIAKAKTKDKQELTENQLAYLQRQQSTRNKLNNSFPGRPSKPIYKGNSHILVGVSLGLEKPVTVAAVDVVSNKVLAYRSVKQLLGQNYKLLNRQRQQQKHLAQKRHESQKKQAPNQFGESELGLYVDRLLAKSIINFAKTYQASSIALPKLRDMREIIQSEIQAKAESKIPGYKEGQEKYAKEYRMSVHRWSYGRLIGNIQAQAAQAGILIETSSGQIRGSPQEQAKHLAISAYIERQTILNK

SEQ ID NO: 487 - protein, 667 aa, Cyanothece sp. PCC 8802
MSTITIQCRLVAPEATRQALWQLMAQKNTPLVSELLRQVAQHPDFETWRQQGKLEAGIIKKLCEPLKKDPRFNEQPARFYTSAIALVDYIYKSWLKLQQRLQRKLEGQNRWLAMLKSDDELIQISQTNIEIIQAKATEILSTLQPQDREQSSKKKAKKCKKSTNKNSLFSQLDKLYNEINNNLTHCAIRYLLKNGGKIPQRPEDTEKFAQRRRKVEIKIERIIEQIESSIPQGRDLTGDSWLETLIIAANTATVEAEDVKSWQDKLLSQSKSIPYPVAYETNEDLTWSINEKGRLCVRFNGLGKHTFQIYCDQRQLKWFQRFYEDQQIKKDGKDHHSSALFSLRSGRIVWQEGLGKGKPWNIHRLTLHCSLDTRFWTEEGTQQVQQEKSKKFQTNRLRMKPELTFSIFFRSQTLETYLQVWLVITAYRLQSFLDKGNVAKAHQEFQKAIKRNESSLQKITSSYNRPHKTLYQGKSHIFVGVAMGLEKPATVAVVDGTTGKAIAYRSLKQLLGNNYHLFNRQGKQKQNTSHQRHKSQKHFADNQFGESQLGQYIDCLLAKAIISVAQTYCAGSIVVPKLKDMRELIQSEIQAKAEAKIPGYVEGQAKYAKSYRVQVHQWSHGRLIDNITSQASKFNITVEEGEQPHQGNPQDKAKLLAIAAYHSRLCA

SEQ ID NO: 488 - protein, 661 aa, Gloeocapsa sp. PCC 73106
MSTITIQCRLVAPETTRQALWELMAQKNTPLVSELLRQVAQHFDFETWRQKGKLEVGIIKKLCEPLKKDPRFSNQPARFYTSAIALVDYIYQSWLKLQQRLQRKLEGQNRWLVMLKSDEELVQISHSSLETIQAKATEILSSLKRDPKSTKKGKNSQKNKSLFTQLYDLYDKTENTLTRCGICYLLKNGCKISKKPEEPEKFAQRRRKVEIKIERLIEQIEGSIPQGRDLTADCWLETLNIAANTATVDATEVKSWQDQLLSQSKSIPYPVAYETNEDLTWSINEKGRLCVRFNGLGKHTFQIYCDQRQLKWFQRFYEDQQIKKNGKNQHSSALFTLRSGRIVWQEGKSKGKPWNIHSLALHCSLDTRFWTEEGTEQIQQEKSQQFQRNRLRMKPELTFGIFFRSQQLETFLQLWLVITAYRFQSFLEKGNIAKANHDFQKAIQRNESSRQKITNSYNRPHKPLYQGKSNILVGVAMGLEKPATVAVVDGTTGKAIAYRSLKQLLGENYPLLNRQRKQKQKSSHQRHKAQKSSSNNQFGESELGQYIDRLLAKAIVAVAKTYQGGSIIVPRLKDMRELIQSEIQAKAEAKISGYVEGQKKYAKSYRVQVHQWSYGRLITEITSQASKLGILIEESEQIYHNNPQKQAQYLAISAYCARLSA

SEQ ID NO: 489 - protein, 650 aa, Calothrix parasitica
MSFKTIQCRLVAEESTRQQLWQLMAHKNTPLINELLLQVAQHPDFETWRKKGKIAKGIITQLCQSLKTDLRFIGQPGRFYTSAITFVDCIYKSWLELMKLNQRRLEGKNRWQKMLKSDAELVEDSSASLDLIRSKATEILAQAQLNSESLSAENQENNKSEKSIKKQKKGKKKNNKKSEESEENKSLSKALFDAYENTEDILTRCAISYLLKNGCKVTNKEEDPEKFTIRRRKLEIEIEDLQEKLEARLPKARDLTDSSWLNNLELATKQVPESEEEAKSWQDALLKKSSSVPFPIAYETNEDMTWFKNEKGRICVKFNGIGEHTFEIYCNKRQLHWFKRFLLDQETKKNSNDQYSSSLFTLRSGLILWQERDKKGKPWNINYLALHCCVDTRLWTAEGTQVVAEEKAEEITRIISNAKKKDNLNKNQLTFIKRKKTTLARINNPYPRPSKPLYKGQSNIILGLYLGLKERATIAVVDVNAGKVLINQSTKQLLGNNYRLIDRQRRQKRKLSHQRKIAQTQSKPNNFKESDLGEYIDRLLAKKIVEIAQKFSASSIVLPKLTNMREQINSEIQAKAEKKCPESIEVQKKYAHQYRINLNNWSYGRLTQNIQNLASQVGLTVEENEQPLKGSPKEKAKELALVAYKARNKS

SEQ ID NO: 490 - protein, 629 aa, filamentous cyanobacterium CCP3
MSQKTIQCRLIAPPATRQYLWMLAAEKNTPLINALIQAVVTHDDFEAWRLKGRHPADVVTKLCKSLKDEAPFSGQPARFYVSAEKAVNYIFKSWFTLQSRLQRQITGKQMWLTILKSDDELTEMCGQDLEAIQKKAVQILAQLEKAVETDKAEGGPGKSAKDLIRVQLFKKHDGAKQPLIRCATAYLLKNGGKLPEKPEDPDKFAQRRRKAEIQVQRLQDQIEARIPKGRDLTGQAWLSALLTATTTVPKDNREHKQWQDKLLAQPRTIPFPILFETNEDLVWSRNQAGRLCVRFNGLSEHTFQIYCDQRQLPWFQRFLEDQNTKRASKNQHSSALFALRSARISWQEAERKGHPWDAHYLTLSCTVDTRLWSAEGTEDVRQEKAAETAKVLARLSEKGRLSDTQQSYAKRLTSTLERLNSPFDRPSYPRYQGNPHIIVSLSLGWDNPLTLAVWNAKTQEVLAYRSLRQLLGKDYALFLRQRREQGKRSHDRHKAQRQGKNNQFGTSNLGEHVDRLLAKAVVVTAQQYGAGSIAIPKLDNIREILQAEIQAKAEQKAPGSIEGQKRYAKQYKSSIHKWSYGRLLDQIASKAAQNGMAIETVKQPWQPNVGEMAKAVAIAAYESRKVVVH

SEQ ID NO: 491 - protein, 639 aa, Calothrix parietina
MSVITIQCRLVADEETLRHLWTLMAEKNTPFANEILEQLAQHAEFESWVKNSRVPATVIKELCDSLKNQELFAGQPGRFYTSATTLVTYIYKSWLAVNKRLQRKIEGKKQWLDMLRSDTELEQESNSNLEKIRAKATEILDSFATRQINQVNSKSKTSKNNKNKQEKEVKSLSIQSNILFETYRQTEDNLTKCAIVYLLKNNCEVNDVEEDIEEYEKNKRKKEIQIKRLEDQLKSRVPKGRDLTGEKWVEVLEKAVNSVPESENEAKSWQASLLRKSSQIPFPVVYETNEDIKWSINEKGRIFVSFNGLGKLKFEIFCDKRHLHYFQRFLEDQDIKRQGKNQHSSSLFTLRSGRISWLEQPGKGKPWNINRLLLFCSIDTRMLTAEGTQQVIEEKIADTQNKIAKAQEKCEGELNPNQQAHINRKKSTLARINTPFPRPSKPLYQGKSHIVVGVSLGLKATATIAVFDAMNNQVLAYRSTKQLLGDNYKLLNRQQQQKQRLSQQRHKSQKQFASNSFGESELGQYVDRLLAKEIVAVAKNFGAGSIVLPKLGDMREIIQSEVQAKAEKKIPGFIELQKNYAKEYRKSAHNWSYGRLIENIQSQATKEGIEIETGKQPTRGIPQEQARDLALFAYQCRIA

SEQ ID NO: 492 - protein, 616 aa, Geminocystis sp. NIES-3709
MAHVTIQCRLIASRDTRQFLWQLMAQKNTPLINEILLRIKQHPDFPHWRTKKRLPKDFLARQIAELKNNYPFEEQPSRFYASVNKVIDYIYKSWFEVQKALDWKLQGNLRWVEMLLPDTELIKHFDNSLESLQQQATLILDSIDSTVSHDRISTILFEKCGKTKKPEIKSAIIYLLKNGCTIPKKPETTEKYQDLKRKVEIKITKLHRQIESRIPLGRDLEDKKWLDTLITASTTAPIDQTEANTWFSILKQNQSSIPYPILYETNEDLKWSLNEKNRLSIRFSGLGEHSFQLCCDHRQLPYFQRFYEDQELKKASKDQLSSALFTLRSAMILWKEDEGKGELWDRHKLYLHCTFETRCLTAEGTSTIVEEKQKEVTKIIDLMKAKEELSDSQQAFIRRKNSTLAKLNNTFPRPSKPVYQGKPNVHLGIAMGLEQPVTIAIVDIETDKVITYRNTKQLLREDYRLLRRRRIEKQKLSHQNHKARKRFNFQQKGESNLGEYLDRLIAKAILTVAQEYQVSTILIPRLRDMRSITEAEIQLRAEKKIPEYKEGQKKYAQDYRVQVHQWSYGRLIENVKLICEKVGIVVVEAKQPKQGTLTEKALQLVLSATEKNLKKK

SEQ ID NO: 493 - protein, 612 aa, Cyanothece sp. PCC 8802
MSQITIQCRLVAKEPTRQTLWQLMAELNTPFINELLQKVAQNPDFEQWRQKGKLQKSVIKQLGDKLKKDPRYLGQPARFYTSGISLVEYIFKSWLKLQQRLQRKLDGKRRWLTVLKSDEELIQQSQQNLEAIRHKASEILQTHQKTEKLFNHLFQLYQEEKNPFTHIALCYLLKNRCKLPQKPEDPEKFTKRRRKVEIAIDRLQEQLEGRLPQGRDLTNHNWLETLSIACQTDPEDTAQARSWQDKLLIQSQSIPFPINYETNEDLTWHKNEKGRLCVKFNGISDLSFEIYCDQRQLKWFQRFYEDQQAKKGSKNQHSSALFTLRSGRILWQEGNEKGQPWNIHRLILQCTLDTRLWTQEGTEEVKQEKAEEIAKVLTSMNEKGDLTKNQQAFIKRKQSTLDKLENPFPRPSQPLYRGQSNILVGVSMGVDKPATVAVVDGITQKTLTIEYIKQLLGNNYPLIQRQRQQKQHQSHQRNVAQRKEAFNQFGDSELGEYIDRLLTKAIVTLAKKYKAGSIVVPKLEDMREIVQTEIQTKAEERIPNCIEAQKNYAKCYRVQVHQWSYSRLIDNIEAQASKLGIVLEISQQPYKGTPHDKAIALALNAYQSRLSA

SEQ ID NO: 494 - protein, 637 aa, Leptolyngbya frigida
MSQKTIECRLVATEDTRRYLWHLMAEKYTPLVNTLLKQVAQDDHFEEWCHSGNLSVAIVKQFCEKLKEDSQFAGQPGRFYSSAIALVHRIYKSWLALRKRVRNKIAGQTRWLAMLKSDDELTEASGSDLDALKVQAEAILAQIQSQTLLNGQSKPKKSRNQKQPTQTLEPKKNNIPNELFKLYDSVDDVLTRCAIAYLLKNGSKIPDKPEDAKKFAKRRRKTEIRLERLMHTLQRTRLPKGRDLSWHNWLKALEQSAKCVPQDETEAADWQASLLTEAAILPFPVNYETNEDLRWFLNEKGRLCVSFNGLGEHTFEVYCDQRQLHWFKRFLEDQEAKKASKGQLSSSLFTLRSGRLAWQAGKHQGDPWNVHRLSLACVVETRLWTTEGTDQVRQEKAATYTKVIAGTKAKGKLNAKQEAFIQKREKTLALLNHAYPRPSHPLYQGQPSLLAGISYGLDKPATLAIVNIQTGKAITYRSLRQLLGENYRLLNRSRLRQQRNAHQRHNNQSKNAPNQFGESNLGEYIDRLIAGAIVAIAQQYQVSSIVLPDVGDLREIIQSEVQARAEQKILGSVERQRQYALSYRSSVHRWSYAQLSQAIQSQAAQIGIAVETAKQSFTGTPQERAKGLAIAAYQARK

SEQ ID NO: 495 - protein, 612 aa, Cyanothece sp. CCY0110
MSQITIQCRLVAKEATRQTLWQLMAELNTPFINELLQQVAQYPDFEQWRQRGRLTAKVIEQLGNELKKDPRFLGQPARFYTSGISLVEYIFKSWLKLQQRLQRKLDGKRRWLEVLKSDEQLIKDSQTDLETIRQKATEILQSYEGTERLFNSLFQAYRDEQNILTQTALNYLLKNRCQLPKKPEDAKKFAKRRRKVEITIKRLQKQINGRLPQGRDLTNDNWLETLNLACDTDPKDVEQSRTWQDKLLKKSQSIPFPINYETNEDLTWSKNEKGRFCVQFNGISDLKFEIYCDQRQLKWIQRFYEDQQVKKDGKDQHSSGLFTLRSGRILWQEGKGKGELWDIHRLTLQCTLETRCWTHEGTEQVKQEKADEIAGILTRMNEKGDLTKNQKAFVRRKQSTLNRLEKPFPRPSQPLYQGKSNILVGVSMELKKPATIAVIDGVTRKVLTYRNIKQLLGKNYPLLNRQQRQKQRQSHQRNIAQRKEAFNQFGDSELGQHIDRLLAKAIISIAQKYQAGSIVVPKLEDIREATQSEIQAKAEAKIPNCIEAQAEYAKKYRMQVHEWSYGRLIDNIQAQASKLGIFIEESQQPLQGTPLQKAAELAFKAYRSRLSA

SEQ ID NO: 496 - protein, 612 aa, Cyanothece sp. PCC 8801
MSQITIQCRLVAKEPIRHTLWQLMADLNTPFINELLQKVAQNPDFEQWKQKGKLQKSVIKQLGDKLKKDPRYLGQPARFYTSGISLVEYIFKSWLKLQQRLQRKLDGKRRWLTVLKSDEELIQQSQQNLEAIRHKASEILQTHQKTEKLFNHLFQLYQEEKNPFTHIALCYLLKNRCKLPQKPEDPEKFTKRRRKVEIAIDRLQEQLEGRLPQGRDLTNHNWLETLSIACQTDPEDTAQARSWQDKLLIQSQSIPFPINYETNEDLTWHKNEKGRLCVKFNGISDLSFEIYCDQRQLKWFQRFYEDQQAKKGSKNQHSSALFTLRSGRILWQEGNEKGQPWNIHRLILQCTLDTRLWTQEGTEEVKQEKAEEIAKVLTSMNEKGDLTKNQQAFIKRKQSTLDKLENPFPRPSQPLYRGQSNILVGVSMGVDKPATVAVVDGITQKTLTIEYIKQLLGNNYPLIQRQRQQKQHQSHQRNVAQRKEAFNQFGDSELGEYIDRLLTKAIVTLAKKYKAGSIVVPKLEDMREIVQTEIQTKAEERIPNCIEAQKNYAKCYRVQVHQWSYSRLIDNIEAQASKLGIVLEISQQPYKGTPHDKAIALALNAYQSRLSA

SEQ ID NO: 497 - protein, 639 aa, Calothrix sp. NIES-4101
MSQITIMCRLVANESTRQQLWQLMAELNTPLINELLVLISQHQDFETWQQKGKIPAGTVKQLCESLKTDPGFAGQPARFYASAIATVSYVYKAWMKVQKRLKSQLESKARWLSMLQSDEELIAIAGVDLDGLRNQARLILQQFAPEPSPQEDLQANKKQPKTEKSLSQTLLDTYESSEDILTRCAISYLLKNGCKVYEKPENSQKFSKHKDKLKVQIQRLIQKLEGRVPQGRNLTDTEWLETLILATEKIPQDEAEAKSWQDSLLKKSSSVIFPVSYESNEDMTWFRNQKGRICIKFNGISEHTFEIYCDSRQLHWFERFLSDQETKKNSKNQHSSALFTLRSARIGWHEQEIKNKQICRRKPTVNPWDIYHLTLYCTVDTRLWTAEGTAVVAAEKAEEIAKIITKTKEKDDLNEKQLAHIKRKNSTLERINNPYPRPSKPLYQANPHILVGVSLGLKKPATIAVVDVISQKVLTYCSIKQLLGKNYKLLNRHRQLKHNFAHKRKIAQTQAKQQQYLDSELGQYIDRLLAKQIIAIAKQYSASSIVLPQLNGMREQINSEIQAKAKEKCPESIEAQKKYAKQYRRSINQWSYGRLIESIISQGLQAGIAIEESKQAVQGSPQEKAKELAFVAYNSRKKS

SEQ ID NO: 498 - protein, 645 aa, Scytonema hofmannii; identical to SEQ ID NO: 448

SEQ ID NO: 499 - protein, 623 aa, Cyanobacterium aponinum; identical to SEQ ID NO: 445

SEQ ID NO: 500 - protein, 629 aa, Alkalinema sp. CACIAM 70d
MSQITIQCRLVAPPTARQHLWTLAAEKNTPLINTLIQEVANHEEFETWRLKGKHPTKIVSEICRRLRTEAPFSGQPARFYTSAEKTVNYIFKSWFTLQSRLQRQLSRKQIWLSILKSDPELVELCGHPLETIQNKATQLLTQIEKTLADSNPEDPQSPCTNDLIRAQLFKKYHGAKTPLIRCSIAYLIKNGGKLPKSPEIPHKFAQRRRKAEIQVQRLQDQLEGRLPKGRDLTGQAWLSTLITATSTVPKDNHEQKQWNDRLLAKPCTTPFPILFETNEDLNWSKNHTGRICVRFNGLSEHTFQVYCDQRQLPWFQRFLEDQQTKHTSKNQHSSALFTLRSAHLAWQETHSNGAGWDNHYITLYCTVDVRLWTAEGTEEVHQEKAVDIAKQLTYLDQKEDLSETQAAFAQRLTSTLDRLNKPFPRPHRHRAQQHSHIIVGLSVDWEAPLTLAIWNANTQEVLVYRSLRQLLGKDYPLFLQHRQEQQKQSHNRHKAQKRNKNCQFGTSHLGEHIDRLLAKAVITIAQQYNAGSIAVPNLDNIRETLQATIDAKAEQKAPGCIEAQKRYTKQYKITIHRWSYGRLIDQIISKAKQVGLGVEEAKQPLSGNVQEKAKLVAISAYNARLIVAF

SEQ ID NO: 501 - protein, 636 aa, Leptolyngbya boryana
MSVITIQCKLVATEETRRALWHLMAEKHTPLINELLKHIAQDSRFEEWSLTGKLPRLVVSEACNQLKQDPQFSGQPGRFYSSAISTVHRIFLSWLALQTRLRNQISGQTRWLAMLQSDNELTIASQTDINTLRLKASELLTHLNEPISESDQPEVKKTRSKKKNQTSNQAGANVSRTLFKLYDETEDPLTRCAIAYLLKNGCKLPDQNENPEKFIKRRRKTEIRLERLMNTFQTTRIPRGRHLSWHSWIEALETATSHIPENEEEAAGWQARLLTKPAILPFPVNYETNEDLRWSLNSQGRICVSFNGLSEHFFEVYCDQRDLHWFNRFLEDQETKKASKNQHSSSLFSLRSGQIAWQEGKGDAEHWVVHRLVLSCSIETDTWTQEGTEEIRQKKASDCAKVIASTKAKENRSQNQDAFIRRRERMLELLENQFPRPSYPLYQGQPSILAGVSYGLDKPATLAIVNIQTGKAITYRSIRQILGKNYKLLNRYRLNQQRNAHKRHNNQRKGGSSQLRESNQGQYLDRLIAHEIVAIAQEYQVSSLALPDLGDIREIVQSEVQARAEQKILGSIEQQRKYARQYRASVHRWRYAQLTQFIQSQAAQVGISIEITKQPLSGTPQEKARNLAIAAYQSRK

SEQ ID NO: 502 - protein, 642 aa, Cyanobacterium sp. HL-69
MLLYKYVLLNIIVDAMSLITIQCRLVASADTRQFLWMLMSQKNTPLINEIFMRIAEHPDFSVWKEKGKLPKNFLAQQIAELKEDKRFQGQPSRFYASVHKMIDYVYESWFTIQDKNKFRLQGHTRWLEMLKPDTEILQCFDGSWEKLQNQAKKILDEIDSTLSHTRIVDKLFKEYEATNDPRIQGAIVYLIKNGASIPDNKVETEKKYKKLKRKVEIQVHKLKKQIEISAPTGRDLNQQKWLDTLILASLASTTMPLNQAQCDRWFSALKKNSPSIPYPVIYETNEDLKWSLSDQNRLHVRFNGLSDHTFKIYCDSRQLPYFQRFYEDQELKKANKNQFSSALFTLRSAMIIWKEDDGKGELWDKHKLYLHCTLDTDYWTVEGTQVVAQRKQKEVLNIIDGMKEKDDLRDTQKKFIQRKETTLARLNNIFPRPGKPIYQGNPNLFLGVAMGLQESVTLALVNVGEGKAILYRNIKQLLGDNYHLLRRRRNEKQKLNHQNHKARKRASFQQKGESNLGEYVDRLIAKSILKIAQEYKVSTIIIPLLSQMRSITEAEVQARAEERIPEYKEGQKKYAKDYRVQVHQWSYGRLIDNIKANSAKVGIVVREGKQPKQGTFTDKALQLALSIQQNITEGKIPRNTKF

SEQ ID NO: 503 - protein, 641 aa, Nostoc sp. 'Peltigera membranacea cyanobiont' 232
MSVITIQCRLVASEDTRRHLWQLMAEKNTPLINELLKQVRIHPDMEQWLKKGKLPDGVIKPLCDSLSTQECFVNQPKRFYKSAIEVVEYIYKSWLALQKERQQKIDKKEHWLNMLKSDIELEQESNFSLNIIRAKAIKVLAHYIAKVEENHKQDITNKNVNKRKKSKSKNNNYTLFDILFKAYDQAKVSLNRCAIAYLLKNNCQVSEEEEDPNRYALRRSKKLKEIERLKEQLKSRIPSGRDLTGQEWLQSLLVATTNVPESENQFKIWQKHLLQNSSSIPFPVQFTSNEDLIWSKNEKGRICVSFSGEEFNNHIFEIYCDKKQIYWFQRFLEDQSIKRNNKKQYSSSLFTLRSGRLAWQDNKGNDLPWKIHRLTLYCSVDTRLWTIEGTQEFRREKVDEITEKLADMEKKENLNKNQQIYVKRLNSTLTKIDTAYPRPNQNLYQGKTSILIGVSLGLEKPATIAIVDCPTNKVLAYRSVKQLLGDNYNLLNRQRQQQQRNSHERHKAQKSNTQIKLSELELGKHIDNLLAQAIITLAKSYQAGSIVLPTMKNVRESIQSEIEARAVKRCPNYKEGQQQYAKQYRQSIHRWSYNRLIGCIKSQAAKANISIEQGPQPIRDSPQEKARDLAIAAYHFRQNKS

SEQ ID NO: 504 - protein, 690 aa, Scytonema sp. HK-05
MSVITIQCRLVAEENTLRQLWELMAEKNTPLINELLEQVGQHPNFEKWLKKGEVPEEAIDTIKKSLITQEPFAGQPGRFYTSAVTLVKEIYKSWFALQQERQRKIEGKERWLKMLKSDIELQQESQCNLDIIRNKANEILTSFVANFTENRNQQFKKKGNKTKKNKKEEEESTLFNALFKIYDKTKDCLSQCALAYLLKNNCQVSEIDEDPEEYVKRRRRKEIEIERLRKQLKSRKPKGRDLTGEKWLTALKEATNQVPVDQLEAKSWQASLLKVTSDIPYPVDYESNTDLDWLIHSNDDDIKKKVILVWQIYFLKQLIKSGSYSFIKYLYFQRGCLPKRDVNWLNLKNKAGRIFVKFNGLRKNIINPEFYICCDSRQRHYFQRLCQDWQVWHDNEETYSSSLFFLRSARLLWQKRKGTGAPWKVNRLILQCSIETRLWTEEETELVRIEKINQAETEIRESEQKGKPKQKVLSHRQKLNNLFPNRPSKPIYKGKPNIIVGVSFGLDKPATVAVVDVANKKVLAYRSTKQLLGKNYNLLNRQRQQQQRLSHERHKAQKRNAPNSFGESELGQYVDRLLADAIIAIAKTYQAGSIVIPKLRDMREQITSEIQSRAEKKCPGYKEAQQKYAKEYRLSVHRWSYGRLIESIKSQAAKVGISTEIGTQPIRGSPEEKARDLAVFAYQERQAALV

SEQ ID NO: 505 - protein, 643 aa, Trichormus variabilis
MSVITIQCRLIASEATRSYLWQLMAQKNTPLINELIEQLGIHPEIEQWLKKGKLPDGVVKPLCDSLITQESFANQPKRFNKSAIEVVEYIYKSWLALQKERQQTIDRKEHWLKMLKSDVELEQESKCTLDAIRSQATKILPKYLAQSEQNNNQTQSQNKKKSKKSKTKNENSTLFDILFKAYDKAKNPLNRCTLAYLLKNNCQVSQKDEDPNQYALRRSKKEKEIERLKKQLQSRKPNGRDLTGREWQQTLIMATSSVPESNDEANIWQKRLLKKDISLPFPIRFRTNEDLIWSKNEEGRICVSFSGEGLNDHIFEIYCGNRQIHWFQRFLEDQNIKNDNNDQHSSALFTLRSAILAWQENKQHKENSLPWNTRRLTLYCTLDTRLWTTDGTEKVKQEKVDEFTQQLANMEQKENLNQNQQNYVKRLQSTLNKLNNAYPRHNHDLYQGKPSILVGVSLGLEKPATLAIVDSSTNIVLAYRSIKQLLGDNYKLLNRQRQQQQRNSHERHKAQKSNMPNKLSESDLGKYIDNLLAQAIIALAKNYQAGSIVLPTMKNVRESIQSEIEARAVKRCPNYKEGQQQYAKQYRQSIHRWSYNRLMQFIQSQAVKANISIEQGPQPIRGSSQEKARDLAIAAYYLRQNKS

SEQ ID NO: 506 - protein, 626 aa, Cyanobacterium sp. IPPAS B-1200
MSLITIQCRLVASADTRQFLWMLMSQKNTPLINEIFMRIAEHPDFSVWKEKGKLPKNFLAQQIAELKEDKRFQGQPCRFYASVHKMIEYVYESWFTIQDKNKFRLQGHTRWLEMLKPDTEILQCFDGSLEKLQNQARKILDEIDSTLPHKRIIDQLFKEYERINDPRIQGAIVYLIKNGASIPDNKVETEKKYKKLKRKVEIQVNKLKEQIEISVPTGRELNDQKWLDTLILASTTMPLNQAQCDHWFSVLQQNSPCVPYPIIYQTNEDLRWSINDKNRLCVQFSGLGGHLFTIYCDSRQLSYFRRFYEDQGLKKSHKDKFSSALFTLRSILLLWKEDKTNKTKGEPWQINRLYLHCTLETDCWTVEGTQVVAQRKQKEVLNIIDGMKEKDDLRDTQKKFIQSKQTSLARLNNIFPRPSKPIYQANPDLYLGVAMGLQEPVTIALVDVSQEKVILYRNIKQLLGDNYHLLRKRRNEKQKLSHQNHKAKKRANFQQKGESNLGEYVDRLIAKSILKIAQEYKVSTIIVPRLKQMRSITEAEVQARAEEKIPEYKEGQRKYAKDYRVQVHQWSYGRLIDNIKGNSSKLGIVVEEGTQPKQGTFTDKALQLALSSSKTNHKANPTKINS

SEQ ID NO: 507 - protein, 674 aa, Calothrix sp. NIES-2100
MSVITIQCRLIAHVATLRYLWKLMAEKNTPLINELLEQVAEHPNFEAWLKKGEVSKTAIKTICNSLKTQERFNNQPGRFYTSAVTLVHEVYKSWFALQQRRQRQINGKERWLNMLKSDIELQQESQCDLNVIRAKATEILNKFNAKFSQKKKYKSKKKANNTKNKNKEFLNNTLFSALFDMYDKTEDCLSKCALAYLLKNNCEVNELDEDQEKYAKNKRQKEIEIERLKKQIISRKPKGRDITAEKWLSTLEKATNQVSQNEDEAKSWQASLLRRDSCMPYPIDYDSDDLEWRVNSLAEKNNILEQSKYDVDNEAYKDVNWSDIKNKEGYILVKFNGLKEIIKHPEFYVGCDSRQLDYFQRFCQDWKIWNENQETYSSGLFLLRSARLLWQERKGKGDPWTVHRLILQCSIETRLWTQEETELVRLEKIDQADKTISNMEKKDSLNKNQVAYLKKTLTTRRKLNNPFPGRPSQALYQGKSSILVGVSLGLDKPATVAVVDAASKKVLTYRSVKQLLGQKYNLLNRQRQQQQRLSHERHKAQKQNAPNSASESELGQYIDRLLADAIVAIAKTYSASSIVLPKLQDLHEIIESEIQVKAEKKVPGYKEGQKNYAKQYRVNIHRWSYGRLFKIIQSQAAKASISIEITSSVIRSSPQEKARDLALLAYQERQAKLT

SEQ ID NO: 508 - protein, 608 aa, Geminocystis sp. NIES-3708
MAVITIHCRLISSKSNRHQLWNLMVQKNTPLINELLLELSQHEDLEQWCELGKLPSGLISKLCDQLKQRAEFEGQPSRFYASAINLVDYIYKSYLRTQRRLRFRLQGQQRWFEMFKSDTEFKNETNFSLTDIRVKARELLDKDLKDSSPDDYFKTYESTSDLLTRSAISYLLKNGRKLPEKPEDYQKFQKRRRKLQIKIEKLQKKIDSSPPMGRNLTNDSWLGMLNLVSNTIPQTDEEAKQWQDQLLRQSKSVPYPVMFNTNEDLRWSKNKKGRLCVTFNGLGKLVFEIYCDQQQLKWFERFYEDQEVKRKGKNQHSSALFTLRSGMLLWQEHEGKQEAWQNNHLTLYCSLDTCFETAEGTELVRQKKVKEVVNLIDAMNNKSERTKTQDAFIKRKQSTLARLDNSFPRPSKPLYQGNQNIVVAVSMSLEYPATIAMFNMSSQEVLTYRSTKQLLDNNYHLLNRQRNQKQRLSHQRHKTQRQNSSDFFTQQESELGQYLDRLLAQSIVSIAKQYQASTILLPNLKNIRDSIQAEIEAKAEAKIPNCKEAQKKYLKNYRINIHHWSYGRLIDSIQLQASKLDILIQEVKQPIRGSPQEKAKQMAILTLE

SEQ ID NO: 509 - protein, 643 aa, Leptolyngbya ohadii
MSIITIHCRLTAPESVRRHLWLLMSGRNTPLINDLLKRVSQHPDFETWQYWGTVPKVAIKELCEPLKELYPGQPARFYASAILMVTYIYESWLSLQQTRRHRLNGKQRWLEVVKSDAELLEMSSSTLETIRHRAQEILSRCNVESTPQSESSTKKRSKQQGQSSASSSKSLMTRLFETYNSADDILSRCAIAHLMKNDCKVSATEEDPKEFAHRILRKQKDIEQLEAQLQARLPKGRDLTGEEFLKTLTIATQQISASVAEARDWQGKLLTRPKSLPYPIIYGSSTDVRWGKTAKGRITVSFNGIDKYLKEADSEIQEWFKTQKEYPFRLYCDQRQLPFFQRFLEDWQAYQANKDTYPAGLLTLSSATLGWREGEGKGEPWQVNHLVLYCSFDTRLMTAEGTLAVQQEKASKALKNLARENSDPRNLSTLNRLQNLPERPSRKPYQGNPEILVGLSVGLTHPVTVAVVNGRTGDALTYRTPRTLLGDRYPLLNRQRQRQKQNALQRHKNQKRGVAYQPSESELGQYVDRLLAKSIIQLAQQYQAGSIVIPNLKHLRELLSSEITAKAEQKCSGSVEAQDKYAKEFRQRIHRWSYNRLLEAICSKANQVGITIETGFQPSKGTFQEQAKDLAIATYHSRAINKK

SEQ ID NO: 510 - protein, 641 aa, Lyngbya confervoides
MSKITIQCRLVASEATRQYLWHLMADIYTPFVNEILRQIREDDNFEQWRQSGKIPASVFEDYRKTLKTESRFQGMPGRWYYAGREEVKRIYKSWLALRRRLRNQLAGQNRWLEVLQSDETLMEVSGLDLSALQAEASQLLNILGSKNKTSKNRSKKAKGKPKGKSAKDPTLYQALWELYRETEDIAKKCVIAYLLKHKCQVPDKPEDPKKFRHRRREAEIRAERLNEQLIKTRLPKGRDLTNEQWLQVLEIATRQVPKDEDEAAIWQSRLLTDAAKFPFPVAYETNEDLKWFLNGKGRLCVSFNGLSEHTFEVYCGQRQLYWFNRFLEDQQIKKENQGERSAGLFTLRSGRLVWKPYSSDASRSDPWMANQLTLQCSVDTRLWTAEGTEQVRQEKATSIAKVIAGTKAKGNLNQKQQDFITKREKTLELLHNPFPRPSKPLYQGKPSIIAAVSFGLEKPATLAIVDIVTDKAITYRSIRQLLGQNYKLFTKHRLKQQQCAHQRHQNQVESAENRISEGGLGEHLDSLIAKAILETAAEYGASSIVLPELGNIREIIHAEIQAKAERKIPGLKEKQDEYAAKFRASVHRWSYGRLAQKVTTKASLHGLETESTRQSLQGTPQEKARNLAISAYESRKVAQRA

SEQ ID NO: 511 - protein, 648 aa, Nodosilinea nodulosa
MAQITIQCSLVASEATRQYLWHLMADIYTPFINEMLVRIGQHPNFEEWNQKGKIPADVFEDLRKALKEDPAFRGIPGRWYHAGRDLVKRIYKSWLTKRRRLYSQLAGQTHWLTILQSDDELIAACNQDLGVIRAEAAALLVKAEGAAPPSPSAKKSKKSPCPQKKAQKEKSAQPSKSLYPWLFEAYKTAETDLSKCAIAYLLKHNCQIPTKAEDAKKFQKRRRKAEIRVERIIEQLARTRLPKGRDLTDEKWLDTLKMAVQQVPKDEAEAAAWQADLLTDSSPLPFPIAYETNEDLKWSQNAKGRLCVSFNGLAEHSFEIHCDIRQLHWFQRFLDDQTIKKQGRKSHSAGALTLRSGRISWRLDAGKGNPWDRNRLVLFCSVDTLLWTKEGTEKASQEKASKIAQMISGTKAKGNLTNEQEDSVRKKEKTLALLQNPFPRPSRPLYEGSPTVLAGVSFGLDKPATLAIVDITTGQAIAYRSIRQLLGDDHKLLNRQRQRQRKKAQLRRSKQLKFAPNRISKEGLGDQIDSLIAKAIVQIAQQYNASSIVLGDLANIREIIESEVKAKAEQKTTLKEIQAKYALDYRTSIHRWSYNRLAQKIESKALQAGLSVETIKQPLTGSPQDKAREVAIAGFQARNVRKILDTGS

SEQ ID NO: 512 - protein, 612 aa, Cyanobacterium aponinum
MSIVTIHCRLIAPESCRSKIWDLMALKNTPMINEILKRLSNHEELESWYQTGRLPNGLVTKICDQLKNQPPFDNQPSRFYLSVTNLVEYIYKSYLRTQKQLRFRLQRQQRWYQMLKSDSELKQEAQCSLTDIRNKAQSLLAKYTNAESLSQSLFDAYNLAEDKITKVAISYLLKNGCKIPQKVENIERFVKRRRKVKIKIERLEKRIAESSPPMGRDLSDEKWINILNIVCQSAPQTDEQGKQWQDQLLKQSKSVPYPLIFNTNEDLIWSKNEKGRLCVTFNGLTKKGFVFEVCCDQRQLKWFERFYQDQQVKRQSKNQHSSALFSLRSGMLLWREGEGKQKPWTKNHLALFCSLETQFETIEGTELIKQQKVEEVLKTIENIKNKGELTKTQENFLQRKQSTLARLDNPFPRPSKPLYQGNPTIVIGVSMGIEKPATIAVVNQSTGEVIAYRSLKQLLGDDYKLLNLQRLHKQKQSHKRHKSQRDSSSRKCNKSQSELGQYIDRLLAKEIVAIARTYKVGRIVVPSLNNIRESIQAELTAKAEAKIQGSLEAQKRYLKNYRINVHQWSYGRLIENITLQASKLNIIVTEAKQSIRGSPQEKAKHLALSSKD

SEQ ID NO: 513 - protein, 729 aa, Fremyella diplosiphon NIES-3275
MLNIYAIIKHMCFIDERMSQITIQCRLVASESTRQQLWKLMAEKNTSLINELLVQVAQNPEFETWRQKGKHPSSIVKELCQPLKTDPRFIGQPARFYTSAIATVNYIYKSWFALIKRSHFQLEGKIRWWEMLKSDTELVELSGMTIESLRSKAAEILAQFTLKSDTVEAKPATENKRKKTKKSKASDSDRSMSKTLFEAYHDTKDILTSCAISYLLKNGCKINDKEEDTQKFAKRRRKLEIQIERLREQLEARIPKGRDLTDAKWLETLLLATRNVPKSELEAKSWQDDLLKKSSKLPFPVGYESNEDMTWFWQFSLYNIAINLRFFWLWIYIDYLIAIVFLRDVLQIEKQWLHNLEINNTSLLIKLWNLALELNCLASILFLHESLHKYKRRLCVQFNGLSKHTFKVYCDFRDLHWFQRFFEDQRIKKNSKNQHSSSLFTLRSGCICWQEHEGKGKEWIVNRLILYCCVDTRLWTAEGTNQVREEKAEEIAKAITRTIARGELNEKQLAFIRRKNSTLARINNPFPRPSQLLYKGQSHILVGVSLGLEKLATVAVVDGSTGKVLTYRSIKQLLGDNYKLLNRQRQQKHTLSHQRQIAQILAAPNQLGESELGQYVDRLLAKEIVAIAQTYKAGSIVLPKLGDMREQVQSEIQAKAEQKSDLIEVQQKYAKEYRVSVHQWSYGRLIANIQTQAAKVGIVIEEAKQPVRVSPQEKAKELAIAAYNYRQKT

SEQ ID NO: 514 - protein, 646 aa, Geminocystis sp. NIES-3709
MLVKNCLSIIIIVQLEDNIFSINFIKTLTIRKTICYFKVMTIKTICCQLIAPEQTRQRLWQYMAEQYTPLMTELIRQVGEHPDLSQWQDKGKMPSNIVKDLCATLKQIRPFTGLPSNFYQSAINQVNYIFASWLASQHKLKLRLNGKRYYFSMLYSDQDLVKNSGHTLTEIRSQAQIILNQISNKKTEEKHKYLFQHHRESSNILGKTAITYLIKHNQKIPTEPEHRDKFEKLYRKTQIQIEKLEKQIEARLPKGRNLSEQQWLNTLITASQNVPKDENEAKLWQKYILTDSNSLPYPVSYETNENLVWSLDEQGRLNLRFNGLGKLTFKVYCDNRQLHYFQQFLQDQTIKKSGKNKHSSGLFLLRSAMLVWKPNESKGKSWNKNTLHLHCAIDTRLLTLEGTQEVREEKLTQVTNIIQSMEKKPSLNDNQKQCLKRKKTSQKNLHESFLRPSRAKYQGNPNIIVGVALGLKHPVTVSIVDMATQKVIAYRSTKQLLGKNYKLLNRYKVQKQRQAHQRHVNQRQSSSVSFGDSNQGKYLNDLLVGAVMDLATQYQAGNIVLPKLDHIREIVESEIKVKAEKKIPLSVDLQKKYAKTYRMSVHQWGYGLFIDGLQNQAKRLSISIEERKQPIRGSPQEQSRDLVLGK

SEQ ID NO: 515 - protein, 719 aa, Tolypothrix sp. PCC 7601
MCFIDERMSQITIQCRLVASESTRQQLWKLMAEKNTSLINELLVQVAQNPEFETWRQKGKHPSSIVKELCQPLKTDPRFIGQPARFYTSAIATVNYIYKSWFALIKRSHFQLEGKIRWWEMLKSDTELVELSGMTIESLRSKAAEILAQFTLKSDTVEAKPATENKRKKTKKSKASDSDRSMSKTLFEAYHDTKDILTSCAISYLLKNGCKINDKEEDTQKFAKRRRKLEIQIERLREQLEARIPKGRDLTDAKWLETLLLATRNVPKSELEAKSWQDDLLKKSSKLPFPVGYESNEDMTWFWQFSLYNIAINLRFFWLWIYIDYLIAIVFLRDVLQIEKQWLHNLEINNTSLLIKLWNLALELNCLASILFLHESLHKYKRRLCVQFNGLSKHTFKVYCDFRDLHWFQRFFEDQRIKKNSKNQHSSSLFTLRSGCICWQEHEGKGKEWIVNRLILYCCVDTRLWTAEGTNQVREEKAEEIAKAITRTIARGELNEKQLAFIRRKNSTLARINNPFPRPSQLLYKGQSHILVGVSLGLEKLATVAVVDGSTGKVLTYRSIKQLLGDNYKLLNRQRQQKHTLSHQRQIAQILAAPNQLGESELGQYVDRLLAKEIVAIAQTYKAGSIVLPKLGDMREQVQSEIQAKAEQKSDLIEVQQKYAKEYRVSVHQWSYGRLIANIQTQAAKVGIVIEEAKQPVRVSPQEKAKELAIAAYNYRQKT

SEQ ID NO: 516 - protein, 682 aa, Cyanothece sp. PCC 8801
MTLKTLECRLYAPSDTLRYLWLLMAEKNTPLINEIINHLSEHPDFDQWFKAKQIPKSAISDICNDLKSQENYQNQPGRFYSSAISLTHYMFKSWFAVHKQLQRRIEGKRRWLNLLKSDQELEQNCGQSLEIIIQKAEEILKLMDSEKSQSSSKPKKPKKPKKKKKSSSEETITLFDRLFKAYNQGNDSLESYALAYLLKNNGQIPEDDEDLDKFALRKRKKEIEIERLQQQLENRIPLGRDLTGELWQEMLTIVNESIPQDENEASAWQAKLLKKSHNIPYPVAYETNTDLKWSKDSRGHLLVTFNGLVESLKKLNLNPEFEIRCDRRHLPWFQRFCKDQEIKANNDQHSSALFVLRSARLIWREGQGKEDPWKIHQLYLQCSVETQLWTEAGTKQVQSEKMVEFQLNQLRMKPELTFPIFFRSQSLPTYFNLWKVITSYRILKFLEKGDFTKAQKNFQDAIKRTESCLENLQSSYLTSQKSLYQGNPEIIMGVAMGLSQPATIAVVNVVTQEVLTYRSLKQLLGKNYNLLNRQRQQKQKLSHQRHKAQKKDAFNQYGESELGQYVDRLIAKAIVQVAKEYQADSIAVPKIRQMREIIQSEVQARAERKIQGYKEGQKKYAQQYRENVHQWSYGRLIESIHQASAKFGIRVEIASQSYQGSFQEQAQNLAIAAYTNRLEAVG

SEQ ID NO: 517 - protein, 637 aa, Microcoleus sp. PCC 7113
MSIITVQCQLKATKDSLRHLWSLMVEKNTLLVNELLKQINTHPDLENWLKVGNIKAEVIEGLCDNLRTESRFQDMPGRFANAAEKLVKDIYKSWFALQEERRFRLWRKQRWFSLLRSDLELEQESGLSLEKLRTEATKILIKAQLECSREAEPDQATTDNSSALWDNLFTAYDKFKSPRLRCVIAYLLKNGCQVNKVEEDPEAYQRRRRKKEIQIERLKEQLKSRLPKGRNLSEQEWLEALEQAQGLIIDDEHLRQVQASLTRKQSPVPFSISYETSTDLRWSSNEQGRICVSFNGKGISKHTFEVFCDQRQLHWFERFYEDYKIFTQNKDQVPAGLLTLRSARLVWQEGEGEGEPWQVHRLLLHCSVETRLWTAQGTEEVRAEKIAQTQAAIDRQKAKGTQSKKLNTSLERLKTFQGFSRPSRASYKGNCSIVIGVSFGRAKPATVAVVNVETGEVLAYRDVKQLLNKPIKEGKTKKKKTQYEYLKRRQEQQRLNSHQRHNAQKNGAPCNFGESKQGEYVDRLLAKAIVEVASQYRASSIVLPDLRNIEEAAESEVRARAEQKFPGNQKLQDSYAKDYRASIHCWSYSRLAQCIELKAGKAGIATEKVHQPHGDTPQEKARDLVLAAYANRKVSVS

SEQ ID NO: 518 - protein, 643 aa, Cyanothece sp. PCC 7425
MSMYTIHCHLTASEPVRRHLWYLMAGSNTPLVNNLLKLVSQHPDFETWQRKGDISKSSVEALCEPLKETYPGQPGRFYSSAILRVTYTYKSWLALQKNRRYRLEGKQRWLHVVESDSELLHRSGSSIETLKYRAQDILVQLNVEQQTQKTSVTDISTITPEETPSSKNESLFPSLFRAYDSEDDILSRCAIAYLIKNGGKIPETEEDQEKFTQRVNSKREEIEQLEIELSARYPKGRDLTGEEFLETLAIATQQLSETVAQAREWNDKILTQPKFMPYPIIYGSSTDVRWRKTSKSRITVSFNGIDKYLKAADPEIKAWFKDHQEYPFRLHCDERQLPFFQRFLEDWQFYQANKETYPAGLLTLSSTLLGWREGEGKGDPWNVNRLALYCTFDTRLMTAEGTLDVQKEKSEKALKNLAKAKPDPRNHSTLDRLKNLPVRPSRTPYQGNPEILVGLRVGLTNPITAAVVNGRTGEVLTYRTPSTLLGDRYDLFNRHRHQQEQNALERHKYQKRGVTYQPSESELGKYVDRLLAKAIIELAQTYKAGSIVIPCLTHLREILASEIAARAEEKCPGSVEAQDNYAKEYRRKIHNWSYNRLISAICSKAEQLGIIVESGFQPYEGDSYQQAKDLAIAVYHSRQLALK

SEQ ID NO: 519 - protein, 671 aa, Scytonema sp. NIES-4073
MSRNSKKDFKSPILRTIRCHLYASEDVLRKVWEEMTQKNTPLIVQLLKSVSEQPEFEANKENGKITKKEITELRKSLTQDSDLDKQSGRLRSSADTFVTEVYSSWLTLYQKRKSQKERKEYFLNNILKSDFELVEESNCDLQTIRFKAQEILSQPEKLLQQIIIENGNKAEINSSRKKGIKNSNNQNSNTKENANEGNSKTLTDILYEIHKKTRDIVTQCAVAYLIKNYNQVSELEEDIQKLKKRRSQKEIEIKRLEKQIKNNQLPNGRDISGKTYIQALDNLINQVPNDNEEYANWLACLSKKISALPYPIDYLYGDLSWYKNEEEKIFVYFNGWADYHFQIHCNKRQRHFFERFLEDHEAFKKNEKSEEKLSGGLITLRSAQLLWQQGEGKGEPWKVHKLALHCTYDARLWTAEGTEEVREEKTDKTQKQVIKGEENENLDKKEQTQLKKNKSSLSRLNNSFTRPSKLVYRGQPHIIVGVSFHPVELATVTVVDVNTKKVLTNKTVKQLLGDDFDLLSRRRRQQVHLRKEREKAQKKDSPCNIGESKLGEYVDKLLAKRIVEVAKYYQASCIVLPTLKDTREIRTSVIQAKAETKFPGDVNAQKLYVKEYNRQIHNWSYTRLQESIKLKAAESKISIECGIQPHYDTLQEQARDLALSAYQCRINTIGR

SEQ ID NO: 520 - protein, 679 aa, Nostoc sp. KVJ20
MSSDRKKKSTIPVHRTIRCHLDASEDILRKVWEEMTQKNTPLILKLLKSVSEQPEFEANKEKGEITKKEIVKLRKNVTKNPELEEQSGRLRSSAESFVKEVYSSWLTLYQKRKRQKEGKEYFLKNILKSDVELIDESNCDLETIRSKAQEVLSQPEEFIKQLTINDEDVKPTKSARKRVNKNINNKSTDAEQRKDSSSTNNVDKNKLETLTNILYEIHKQTQDILTRCTVAYLIKNHNKISNLEEDIQKLKKRRNEKIVQIKRLENQIQDNRLPSGRDITGERYSEAFGNLINQVPKNNQEWEDWIANLSKKISHLPYPIDYLYGDLSWYKNDVGNIFVYFNGWSEYHFKICCNKRQRHFFERFLEDYKAFKVSQKGEEKLSGSLITLRSAQLLWQQGEGKGEPWKVHKLALHCTYDSRLWTAEGTEEVRKEKTDKAQKRVSKAEENEKLDDIQQTQLNKDKSSLSRLKNSFNRPGKLIYQSQSNIIVGISFHPIELATVAIVDINTKKVLACNTVKQLLGNAFHLLSRRRRQQVHLSKERKKAQKKDSPCNIGESKLGEYIDKLLAKRIVEIAKFYQAGCIILPRLKDMKEIRTSAIQAKAEAKIPGDVNAQKLYVKEYNRQIHNWSYNRLQESIKSKAAEFKISIEFGIQPHYGTLEEQAKDLAFYAYQSRNHTLGR

SEQ ID NO: 521 - protein, 641 aa, Cyanothece sp. PCC 7425
MYTIHCHLTASEPVRRHLWYLMAGSNTPLVNNLLKLVSQHPDFETWQRKGDISKSSVEALCEPLKETYPGQPGRFYSSAILRVTYTYKSWLALQKNRRYRLEGKQRWLHVVESDSELLHRSGSSIETLKYRAQDILVQLNVEQQTQKTSVTDISTITPEETPSSKNESLFPSLFRAYDSEDDILSRCAIAYLIKNGGKIPETEEDQEKFTQRVNSKREEIEQLEIELSARYPKGRDLTGEEFLETLAIATQQLSETVAQAREWNDKILTQPKFMPYPIIYGSSTDVRWRKTSKSRITVSFNGIDKYLKAADPEIKAWFKDHQEYPFRLHCDERQLPFFQRFLEDWQFYQANKETYPAGLLTLSSTLLGWREGEGKGDPWNVNRLALYCTFDTRLMTAEGTLDVQKEKSEKALKNLAKAKPDPRNHSTLDRLKNLPVRPSRTPYQGNPEILVGLRVGLTNPITAAVVNGRTGEVLTYRTPSTLLGDRYDLFNRHRHQQEQNALERHKYQKRGVTYQPSESELGKYVDRLLAKAIIELAQTYKAGSIVIPCLTHLREILASEIAARAEEKCPGSVEAQDNYAKEYRRKIHNWSYNRLISAICSKAEQLGIIVESGFQPYEGDSYQQAKDLAIAVYHSRQLALK

SEQ ID NO: 522 - protein, 678 aa, Nostocales
MSRDRQKKSTSPIHRTIRCHLHASEDVLRKVWEEMTQKNTPLIVQLLKSVSEQPEFETNQEKGTISKKEITKLRKALTNDSDLQQQSGRLGSSADSLVTEVYTSWLTLSQKIKKQKEGKEYFLNNILKSDVELVQESNCDLQTIRCKAQDILSQPKEFLEQITNHDAVLNQTKSARKKVQNSSNEINASKQRENSDYQENVDKNIPETLTEILYKIHKITQDILTQCAVAYLIKNHNQVSDLEEDIKKLKKRRTEKQVQIKRLEEQIQKNKLPNGRDITGERYNHAFDNLINQVPQNNEEFAEWIASLLNKVSDLPYPIDYLYSDLTWYKNEQRKICVYFNGWAKFHFQICCNKRQLHFFKRFLEDYKALKESEKGEIKLSGSLVTLRSVQLLWQQGEGAGEPWKVNKLALHCTYDARLLTAEGTEEVRQEKTDTTQKQVTKAEGNENIDSDEQKNLNRNISSLSRLNNSFARPSKPIYRGQSNIIVGVSFHPVELATLVVVDIITKEKIICKTVKQLLGDAFSLLSRRRRQQVHFRKEREKAQKKDSPCNMGESQLGEYVDKLLAKRIVEVTKEYKASCIVLPRLKDTREIRTSVIQAKAEAKFPGDVNAQKIYVKEYNRQIHNWSYGRLQESIKSKAAEFKISIEFGMQPSYDNLQEQAINLALSAYQCRINTIGR

SEQ ID NO: 523 - protein, 665 aa, Nostoc sp. NIES-4103
MSSTSGKNLTNPIFRTISCDLSAKEDVLRKVWEEMSQKNAPLIVQLLKSVSEQPEFEANKENGTITKREITKLRRDITENSDLKEQSGRLRSSADSLVTEAYSSWLRLYQVRKNQKEGKEYFLKNILKSDVELVEQSNCDLQTIRCKAKEILSQVEEFIEQIKNKPKINQTKLAKKKNNKSNKSNKAIDKILNRFFIGNLDKTLTNTLYEIHRKSPDSLTQCAVAYLIKNDNKVSEAEENFTQLNKRRAAKEIEIKRLETQIQNTRLPIHYGRDITGEKYSQAFEKLVNQVPQDNEEFAEWIAILLKKVSSLPYPILYCSGDLSWYKDEKGNIFVYFNGWAEYHFQICCDKRQLRFFERFLKDYKALKPSKKEEEKVSGSLVTLRSAHLLWRQGKGKGEPWKVNKLALHCTYDARLWTAEGTEEVRQEKTDKAQAKVNKAESNENLNSEQQKELTKNKSSLSRLKNSFARPSKPLYRGQSNIIVGISFHPVELATLVVVDINTKEILICKTVKELLGDAFPLLSRRRRQQVHFRKEREKAQKKDSPCHLGESKLGEYVDRLLAKRIVEVAKEYQASCIVLPGLKGIREIRTSAIQAKAETKFPGDINVQELYVKEYNRQIHNWSYSRLQESIKSRAAELKITIKFGKQPSHSTLQEQAINLALSA

SEQ ID NO: 524 - protein, 584 aa, Geminocystis sp. NIES-3709
MAEQYTPLMTELIRQVGEHPDLSQWQDKGKMPSNIVKDLCATLKQIRPFTGLPSNFYQSAINQVNYIFASWLASQHKLKLRLNGKRYYFSMLYSDQDLVKNSGHTLTEIRSQAQIILNQISNKKTEEKHKYLFQHHRESSNILGKTAITYLIKHNQKIPTEPEHRDKFEKLYRKTQIQIEKLEKQIEARLPKGRNLSEQQWLNTLITASQNVPKDENEAKLWQKYILTDSNSLPYPVSYETNENLVWSLDEQGRLNLRFNGLGKLTFKVYCDNRQLHYFQQFLQDQTIKKSGKNKHSSGLFLLRSAMLVWKPNESKGKSWNKNTLHLHCAIDTRLLTLEGTQEVREEKLTQVTNIIQSMEKKPSLNDNQKQCLKRKKTSQKNLHESFLRPSRAKYQGNPNIIVGVALGLKHPVTVSIVDMATQKVIAYRSTKQLLGKNYKLLNRYKVQKQRQAHQRHVNQRQSSSVSFGDSNQGKYLNDLLVGAVMDLATQYQAGNIVLPKLDHIREIVESEIKVKAEKKIPLSVDLQKKYAKTYRMSVHQWGYGLFIDGLQNQAKRLSISIEERKQPIRGSPQEQSRDLVLGK

SEQ ID NO: 525 - protein, 617 aa, unclassified Cyanobacteria (miscellaneous)
MSLKTIRCRLVAPEESRKAIWTLMAERNTPLVNEVLRRVPEQTDFAKWQKSGRLPDRSVAQIVESLKTDPRFIDQPAWYYISAKKQVAYTFRSWLKLQHRKQWKLEGKRRWLSILQPDSELAKQANYTLAELRQAATRILNQIDALEPFKYLLCDYGRSKSAKRRSTLAYLLKRNAQLVPEVENLDKLRKRHHKTEIAIQRLEIQLQASLPKGRDLMESAHIEALVQSIQSPPLEDKDFVTWQQNLTRKPAKLPFPVIYETVESLTWAHDDKGYLLVRFQGKGTGEHVFRVYCDKTHQHWFERFLDDQETKRTSGDKHSAGLFTLRSAKLSWVVSKTHLHEAEPWNRYHLCLLCTVDTRLWTMEGTQLVKAQKAAGTAAKLQSRRAKEGLSKNQQADIRRLESTLERLEVPYSRPSRMLYQGTDNILVGISMGLDQPATVAVVNVSTQEMLAYRSTKQLLGDKYKLLNRARTERARIAHQGHRQRLKGGKRINSESQLGVYIDRLLAKAIVEVAQQYQAASIVLPDLKDIREIVEAEVGQRAAVRVPDFIDGQRRYAKAYRAQVHQWSYRRLQAAITSKAEQSGLVVETVRQQCIASDQEKAKALALKAYTNRVNVV

SEQ ID NO: 526 - protein, 665 aa, Nostoc cycadae WK-1
MSAIYRTIRCYLYASEDILRKVWEEMTQKNTPLIVQLLKLVSEQPEFEANKENGTITKKEITELRKPLTDDSDFQEQSGRLCSSADSLVKEVYSSWLKLYQQRKKQKEGKEYFLNNILKSDAELVQESQCNLQTIREKAQEILNNPEKFSEQVTNNQNVKQKKSLRKKSNNDNKEIKQSKNQAYKENEDESSPNTLTDILYKIHREAQDILTRCAVSYLIKNNNKVSDIEEDITQLEKRRIQKQVEIKRLEEQLKNSKLPKGRDITGTKSSQAFNNLINQIPKDDEEFAEWVATFLRKISKIPYPIDYGSSDLSWGKDKKGNIFVYFNGWAKYHFQICCNKRQLHFFERFLEDYKAFKASEKGEEKLSGSLVTLRSAQLLWQQGEGKGEPWKVNKLALHCTYDARLCTAEGTEEVRQEKTDKAQKEITKAETHENLDSNEQKKLNKNKSSLSRLKNSFARPSEPTYRGHCNIIVGVSFHPTELATLAVVDVNTKKILVCKTVKELLGNSFRLLSRRRRQQVHFRKEREKAQKKDSPCNIGESQLGEYVDKLLAKRIVEVAKTYKASCIILPRLKDATEIRTSVIQAKAETKFPGDVNAQKLYVKEYNRQIHNWSYSRLQESIKSKAGELKISIEFGIQPSYDTLQEQARDLALSAYQCRINTIDR

SEQ ID NO: 527 - protein, 678 aa, Nostocales
MSRDRQKKSTSPIHRTIRCHLHASEDVLRKVWEEMTQKNTPLIVQLLKSVSEQPEFEANQEKGTISKKEITKLRKALTNDSDIQQQSGRLGSSADSLVTEVYTSWLTLSQKIKKQKEGKEYFLNNILKSDVELVEESNCDLQTIRCKAQDILSQPKEFLEKIINNDAVLNQTKSARKKVQNSSNEINASKQSENSDLKENVDKNIPQTLTEILYKIHKITQDILTQCAVAYLIKNHNQVSDIEEDIKNLKKRRTEKQVQIKRLEEQIHNKKLPNGRDITGERYNQAFDNLINQVPQDNEEFAEWIASLSTKVSHLPYPIDYLYSDLTWYKNEQEKICVYFNGWAKFHFQICCNKRQLHFFKSFLEDYKALKESEKGETKLSGSLVTLRSVQLLWQQGEGAGAPWKVNKLALHCTYDARLLTAEGTEDVRQEKTDTTQKQVTKAEANENIDSDEQKNLNRNISSLSRLNNSFARPSKPIYRGQSNIIVGVSFHPVELVTLAVVDIITKEKIICKTVKQLLGDAFSLLSRRRRQQVHFRKERKKAQKKDSPCNIGESQLGEYVDKLLAKRIVEVAKEYQAICIVLPTLKDTREIRTSVIQAKAETKFPGDVNAQQLYVKEYNHQIHNWSYSRLQESIKSKAAELKISIEFSIQASYDTLQEQAINLALSAYQCRINTIGR

SEQ ID NO: 528 - protein, 692 aa, Nostocaceae
MILVTQIEKGVFAGDIVTMSRDRKKGSKSPSLRTIRCHLHTKEDVLRKVWEEMTQKNTPLIVELLKSVSEQPEFETNKENGKITKKEITNLRKSLTQDSGRLYSSVDNLVQEVYSAWLTLYQKRKKQKEGKEYFLNNILKSDIELVEESNCDLQILRAKAQEIISNPQDILRQITIDNPKDKPTKSIQKRVRKNINASNSDTAKNNILNSQEKTTEENISKSVIEILYEIHKTTQDTIIRCAVTYLIKNYTKISDTEEDLNKLKERRAEKEIEIKRLEKQIQDSRLPNGRDITGARYLEAFDKLINQVPKNNEEFANWIADASRKISNLPYPIDYLYSDLTWYKNQDGKIFVYFNGWSKYHFQICCNKRQRHFFERFLEDHKAWKESEKGEVKLSGSLVTLRCVQLLWQQGEGKGEPWKVNKLSLHCTYDTRLWTAEGTEEARKEKINKIQRQVEQAEETENLDEQQQKQLKKNKSSLSRLNNSFNRPIQPIYQGLSNMIVGVSFHPVELATVAVVDTTTQKVIAYKTINELLDNAFHLLSRMRRQQIHFRKERKKAQKKDSPCNLGESKLGEYVDKLLAKRIVEVAKEYQAICIVLPKLKDMKEIRTSVIQAKAETKFPGNVNAQKLYVKEYNRQVHNWSYNRLQESIKSKAAELKISIEFGIQLSYDTLQAQARDLALSAYQCRIHTIDR

SEQ ID NO: 529 - protein, 674 aa, Nostoc sp. PCC 7120
MSRDRKKGSKSPSLRTIRCHLHTKEDVLRKVWEEMTQKNTPLIVELLKSVSEQPEFETNKENGKITKKEITNLRKSLTQDSGRLYSSVDNLVQEVYSAWLTLYQKRKKQKEGKEYFLNNILKSDIELVEESNCDLQILRAKAQEIISNPQDILRQITIDNPKDKPTKSIQKRVRKNINASNSDTAKNNILNSQEKTTEENISKSVIEILYEIHKTTQDTIIRCAVTYLIKNYTKISDTEEDLNKLKERRAEKEIEIKRLEKQIQDSRLPNGRDITGARYLEAFDKLINQVPKNNEEFANWIADASRKISNLPYPIDYLYSDLTWYKNQDGKIFVYFNGWSKYHFQICCNKRQRHFFERFLEDHKAWKESEKGEVKLSGSLVTLRCVQLLWQQGEGKGEPWKVNKLSLHCTYDTRLWTAEGTEEARKEKINKIQRQVEQAEETENLDEQQQKQLKKNKSSLSRLNNSFNRPIQPIYQGLSNMIVGVSFHPVELATVAVVDTTTQKVIAYKTINELLDNAFHLLSRMRRQQIHFRKERKKAQKKDSPCNLGESKLGEYVDKLLAKRIVEVAKEYQAICIVLPKLKDMKEIRTSVIQAKAETKFPGNVNAQKLYVKEYNRQVHNWSYNRLQESIKSKAAELKISIEFGIQLSYDTLQAQARDLALSAYQCRIHTIDR

SEQ ID NO: 530 - protein, 640 aa, Nostoc cycadae
MTQKNTPLIVQLLKLVSEQPEFEANKENGTITKKEITELRKPLTDDSDFQEQSGRLCSSADSLVKEVYSSWLKLYQQRKKQKEGKEYFLNNILKSDAELVQESQCNLQTIREKAQEILNNPEKFSEQVTNNQNVKQKKSLRKKSNNDNKEIKQSKNQAYKENEDESSPNTLTDILYKIHREAQDILTRCAVSYLIKNNNKVSDIEEDITQLEKRRIQKQVEIKRLEEQLKNSKLPKGRDITGTKSSQAFNNLINQIPKDDEEFAEWVATFLRKISKIPYPIDYGSSDLSWGKDKKGNIFVYFNGWAKYHFQICCNKRQLHFFERFLEDYKAFKASEKGEEKLSGSLVTLRSAQLLWQQGEGKGEPWKVNKLALHCTYDARLCTAEGTEEVRQEKTDKAQKEITKAETHENLDSNEQKKLNKNKSSLSRLKNSFARPSEPTYRGHCNIIVGVSFHPTELATLAVVDVNTKKILVCKTVKELLGNSFRLLSRRRRQQVHFRKEREKAQKKDSPCNIGESQLGEYVDKLLAKRIVEVAKTYKASCIILPRLKDATEIRTSVIQAKAETKFPGDVNAQKLYVKEYNRQIHNWSYSRLQESIKSKAGELKISIEFGIQPSYDTLQEQARDLALSAYQCRINTIDR

SEQ ID NO: 531 - protein, 563 aa, filamentous cyanobacterium CCP5
MSQKTIRCRLVAPESTREAIWQLMAERNTPLVNEVLRQLPENSDFSKWQRRGKLPDLPVKQLVDGLKSDPRFSDQPVWYYISAQKQVTYTFKSWLSLQKRKQCRLEGKRRWLDILRTDSELAGEAKCSVGALRSAASNILKKVDDSDPFKLLLKEYGTSKSAKRQCALAYLLKRDAKLDPEEEDLEKLGQRHSKAEIQIKRLETQLKASLPKGRDLTGQIRAEALTQSVQSPPLDDEAYSAWHASLTREAATLPFPIIYETVESLVWFKDTKGRYSVCFQGQGTSAHTFKVYCDKPHQQWFDRFWIDQETKRSGGERHSAGLFTLRSARLSWIPSKKHQNEPEPWNRSYLNLSCTVDTDLWTQEGTQNVMQEKAAATASKLQSMQEKESLDKNQQGYVRRLESTLTRLQTPYPRPSRALYQGRSDILVGVSMGLDKPATVAVVNALSGEVLTYRSTKQLLGEQYPLLQRARSERTKVAHQGHRQRRKGGKRVNQESNLGKHVDRLLAKAIVEVAHKYQAGSIVLPDLAHIREIVESEVKQRAAEKVPDFIDGQKQYAKAYRVQ

SEQ ID NO: 532 - protein, 660 aa, Cyanothece sp. PCC 8801
MTHITVVQCRLIAPESTLQHIWKMMAQQQTPLINQLLHDINTHPDINTWLTANQLPSKLVETLAQPLKTQSPYQGLPGRFITSAIILVKEMYASWFAIQTQKRLSLEGKKRFLTILKSDKQLIQDSQTDFLTLCYKAQQLLKRTQNKLKLDEPQHSEKAHWSIINALYPAYNNAKTPISRAAFALLIKNNGQVPDTPENPDYYQQRRKRKEIQIRRLEEQLKASLPKGRILDSKHWENTLKLAQTPITTIEEITSLQTQLLQKYSHLPFPVFYGTNTDLTWFKNPQGRICVKFNGLNQYPFQIACNKRQYPWFQRFFTDYQSYKSHKQQVPTGLMVLRSARLLWQPTNGQGEPWNTHHLSLHCAIDNDLWTISGIQQVKQQKILQTEQKIANFHSKALEKELTPNQQQRLKASQTSLNLLKTFDINEFFPSKCSLYQGSPDIILGVSIGLENPATIAIINISTQEILTYRTTKQLLSRTRKVRNKKPNSNNSNQSLSSAYKQISNYELFLQYQQQKHHNQHQRHNAQINDANNNYGEANLGLYLNRLLAKAILELAQQYQVSLIILPSLKNKRELIESEIRAKAELKYPGCKEKQDSYAKDYRTNVHQWSYQQLIKCIESKAAQIGIDTATGKQMNLETSQDQARNLVLNFCQKFSPTQV

SEQ ID NO: 533 - protein, 659 aa, Phormidium tenue
MSIITIQCRLTASVATRQHLWNLMAHSNTPLVSELMRIIPLQPDFENWRQASKIPAKAIRDLCASFRKDERFAGQPGRFYSSASTMVAYTYDAWFALQASRLRRLYGMRRWLEILQSDTEMLKLCGVSWESFQERARAILQTATDQIQAKQPTPQPARRGNKKQRKQSDKIVSRRRLVDRLFQLYNESPETLDRCAIVRLLKNGCTVPEQAEQPERYQRMLLAKQTGVSRIERELASRLPKGRDLTDENFLNALELLTYQIPTSTEEFAQWKSQLLREPNPLPYPVLYSGNLNLTWFVEEVPRGKSQKPKQQICVKLNGLAKHVLKVQCDARQHHYFQRFVQDWDIYNRGKGPISGSLLLLRTASILWKPVQQSRHRATGEPWSDHSLYLHCQIDTKLLTQEGIEEKRQKKLASAQSSEQTRHATPVQAARQQGSLDRLQRSAQHPIHLPSRTPYQGQPQIILGVSFNLKHPVTVAVVDVQSQEVVKYHSSRQLLSTTDPKTDQSHLPQQQMAQQQSHDHERHKALKKDHYAPYKEANLGAYLNQVLAKRVVDIAIQFRVSSIVLPDTKGLRDKLEAQLRAKAASKIVGSVAAQKRYARTASIRLHHWSYNQLAELIKNRAAKLGIPVEVVPGLVADSPQATARDVVFSAYYRRQSASK

SEQ ID NO: 534 - protein, 453 aa, filamentous cyanobacterium CCP2
MTRGAIAYLLKNGGKLPDKPEDLKKFVKRRRKAEIRVERLTSTLKRMRLPSGRDLTDQAWVKTLATAAFDVPENEEEAALWQAVLLSETRKLPFPITYETNGDLTWFLNDNGRLCVTFNGLSEHPFEIYCDQRQLHWFKRFLEDQEVKKASKNQHSSGAFTLRSARIAWQAGKEQGDPWKVHHLVLFCTVETRFWTAEGTQQICEEKAAEYAKVIAGTKAKGNLNKNQEKFIRSREKTIARMQNPFPRPSRPLYQGQPTILAGVSYGLDRPATLAIVDITTGKAITYRSIRQLLGDNYQLLNRYRLRQQRNAHRRHNRQRKGAANQIQESNLGEYLDCLIAKAVVSVAKAYQVSSIVLPDLGNIREMVEAEVQARAEQRIVGYEEGQRQYAKQYRASVHRWSYGRLTEKIQSQAAQIGIMVEQAKQMFQGTPQEKAKNLVTEAYNSRKQEKSS

SEQ ID NO: 535 - protein, 434 aa, Stanieria sp. NIES-3757
MRQKPEDPKKFAKRRRKTEIKVERLLKKLNSQTPKGRDLTGQQWLDTLITVATHVPQDEVQAKLWQDILLTKPKSVPFPITYETNEDMTWSKNEKSRLCVRFSGLGEHIFEIYCDQRQLPLFQRFYQDQEVKKASKNLHSSALFLLRSSRIAWQEGEGKGEPWNVNHLTLYCTLGTRLLTAEGTEQVRQEKAAEIATTLTRMKEKGDLNAKQQAFVKRKQTCLSRINNPFPRPDRPLYQGQAHILLGIYMGLEKPATAAVIDAISGKVITYRSTKQLLGDNYQLLNRQRRQKSFLSHQRHLNQKHHANNQLGESKLGQHLDRLLANAIVNLAKTYQVGSIVLPKLGNMREIVQSEIQALAEQKIPGNKEGQKKYAKQYRVNVHQWSYGRLMENIKAQAAKAGIVIEESKQSIRGSPQDQAKEIAISAYTNRLNY

SEQ ID NO: 536 - protein, 453 aa, filamentous cyanobacterium CCP1
MTRGAIAYLLKNGGKLPDKPEDLKKFVKRRRKAEIRVERLTSTLKRMRLPSGRDLTDQAWVKTLATAAFDVPENEEEAALWQAVLLSETRKLPFPITYETNGDLTWFLNDNGRLCVTFNGLSEHPFEIYCDQRQLHWFKRFLEDQEVKKASKNQHSSGAFTLRSARIAWQAGKEQGDPWKVHHLVLFCTVETRFWTAEGTQQICEEKAAEYAKVIAGTKAKGNLNKNQEKFIRSREKTIARMQNPFPRPSRPLYQGQPTILAGVSYGLDRPATLAIVDITTGKAITYRSIRQLLGDNYQLLTRYRLRQQRNAHRRHNRQRKGAANQIQESNLGEYLDCLIAKAVVSVAKAYQVSSIVLPDLGNIREMVEAEVQARAEQRIVGYEEGQRQYAKQYRASVHRWSYGRLTEKIQSQAAQIGIMVEQAKQMFQGTPQEKAKNLVTEAYNSRKQEKSS

SEQ ID NO: 537 - protein, 711 aa, Crinalium epipsammum
MSDQTSQNNEITIQSLLEAPEETLCFLWQLMVNVTELINSLLHHINTHPDFDIWLTQCAIPASVINSFIKTAKTQSPYREMPTRFITSAQNLVNEMFKSWFEIQRLKRLSLKGKRHFFTILKSDEELQRESDCTFDTLCQEAAIILQQTQLQIEQKRLDANQPPPTLDKQAFWEVAHVLYKAYDQADTPLVRSGIALLLKNQNQVPEQFEDPKKYQQRRQAKQEEIERLEHQLQSKAPKGRLTDQQEWLRILEKASQPITEVAEFRDIQAQLLRKFFALVYPVTFSTNTDLQWSTNQQGRICVQFYGMSKYTFEIACDRRQLNWFKRFLADYQLYKQHKTQIPTGLMPLRCARLVWTEGQDDFALIVATWLLIAVIQHKFYHIAWLLLKNHRIIKSPPWRVHHLHLHCIVDHRLWTQEGKEIVKAEKIPQTEKLINDFQQKERIQENGLTTGQQQRLKASETSLRLLQNCDHFAASKRISYRGQPNRILGVSIGLHEPVTIMIVNTTTGKTLASRNTKQLLDKKRRVRDQQPELPKYEERQHFTNIYKEISDYELFLFYRQQKQQHQHQRHKAQIKATPDHSKEANLGLYINRLLAKAIIEFAQQHQVSTIILPDLKNKRESIESEAKALAKLKIPKDKSRQQQYTRNILSEVSQWSYKQLSDCIINKASQSGIAIEIIQQISQGNPYQKARNLITTFTKNSGNKCSAKIE

SEQ ID NO: 538 - protein, 453 aa, Geminocystis herdmanii
MIVYLIKNGSRIPKNNIETTKKYKRIKRKLEIKIRKLKRQVEMSIPSGRDLEGEKWLQTLILASNTMPVDQNESDSWFSALKRNSPSIPYPIVYETNEDLKWCLNDQNRICIKFSGLSDHLFLIYCDSRQLPYFRRFYEDQELKKASKDQFSSALFTLRSAMIIWKEDDGKGESWDKHKLYLHCTFDTDYWTLEGTQVIAQKKQEEVLNLIDRMKEKTDLTDTQKAFIQRKQTTLARLNNIFPRPSKPIYQGNPNLFLGVAMGLQEPVTIALVDVSTNKVILYRNIKQLLGDDYHLIRRRRNEKQKLNHQNHKARKRANFQQKGESNLGEYLDRLIAKSILQIAEEYQVSTIIVPRLNQIRSITEAEIQARAEERIPEYKEGQRKYAQDYCVQVHQWSYGRLIDNIKAISSKLGIVVEEGKQPKQGKFTDKALQLALSTQKNNRQNNPTKTNS

SEQ ID NO: 539 - protein, 697 aa, unclassified Cyanobacteria (miscellaneous)
MDQVIPGYMKTILCCLCVKVETRRFLWNAMVTYTALVNELLELVSQHPKFEVWRQQGKITRDEVKSILRPLKQNSVYAALPGRFFTSAELMVTYAFKSWLALQKHRHHQMVGKLRWLQVIEADLQAMPTSDLSLEVVQARAQQVLEHAEQSTDTQQGRSSFLSRKGKRRGNPLMGFLLDAYEAASDELERRAICYLLRNDLKVVEEDENPEVIQFRIDRKRIEVERLQDQLQSRLPKGRDPTDERYLEALGAAIALPDVDLSPIDEEDWSQWKAQKQLPLLNPLPYPILWGSSSDLRWSIIANSEADGQPSKRRKSSKRPKEKIQVQFNGLGKHTMSIQCDRRQLPVFKQFAEDYITHESTAEEDKFGMSLFALRSACLVWKKDPQAAVKRRKHKQKAKAQLDKITDYDAPWQTHRLYLHCTVDTRLITKEGSEQVRREKASRAEKLVAASVGKELTKTQQKNLKSNKTSVERLRRQPPERPSANLYHGNPDIVVGISLSRHEPVTAVVLDRSTDRALACQRTKALLKVRSIKKTYPNRSLLQRQKEQCRLVNRWRSQRRYNLSQRPEDQKHDNYRQQDAESALGDYLDRLLAARVIQLAQKWQAGSIVLPSLGNIREIVESSVQAEAERRYPKHKELQDKYAKQYRLEFHRWSYGRLLKYLKECARQHGLTIRQERQPKQGSEQEKALALIASAFL

SEQ ID NO: 540 - protein, 637 aa, unclassified Cyanobacteria (miscellaneous)
MAHLNTPLVTELMQVIQHHNDFVNWQQRRELPMQVVRNLCTSLRLDERFSGQPGRFYSSAAMMVAYTYDAWFALQSSRQQGLDGLKRWIDILKSDADMLELCGLDWKSFQASAKEILQSVTDQLQSDQPKPSPSHKGSQQRREQSDRTVSKRQLVNQLFQLHDESPSLLTRCVAVYLLKNGCAVLEKPEKPERYQRMLLGKKKAAKRLEEQLASRLPKGRDLTDETFLKALELLTYQIPNSAEELARWKAQLLRKPNPLPFPILYGSNNDLTWFVKEKPRGKAKPPKQQICVKFNGLGKHVFRVQCDRRQHHYFQRFVQDWEVYKCGKGPISGSLLLLRTASLLWKPANQSSHQPTGNPWQDNYLYLHCQIDTQLLTREGIEQKRQKKLNSTQNPDLSPSDPASKAARQHQGHVKRLQPIEQYPIPLPSREPYEGQPHLILGVSFALQHPVTLAVVNLQSKQSLYYRSTRQLLKTTDAKTDQSHLLRRRKTQQQRHSYERHKALKREQYAPYQEANLGTYLNQVLAKRVVDVAYQAQVSAIVLPETKGLRDKLEAQLRARAATKIVGSVAAQKRYARAASLRLHHWSYNQLAELIKSKAAKLGIPIEIVPALVADSPQEIARNIALSAYYRRQAAAK

SEQ ID NO: 541 - protein, 393 aa, Euhalothece sp. KZN 001
MTGEQWLETLITAANTVPKDKEEFKSWQNILLTKPKSIPFPISYETNEDLTWSKNEKGRICVKFSGLGDYTFQIYCDQRQLKWFQRFYEDQETKRASKNQHSSSLFTLRSARILWQEGTAKGQAWHRNYITLYCTVDTRLWTAEGTEQIKEEKAEEVARILTNMKDKGDLTKTQEAFIKRKQTTLDRLNNSYPRPSKPLYQGQSHLLLGVAFGLEKPATIAIINGSTGKAITYRSIKQLLGENYKLLNRHRKQKQVQSHQRHKNQKKFAPNQLKNSELGEYIDHLIAKAIVNIAQEYKVGSIVIPKLENIRELIQSEVKMRAEKKVPGYLEGQKKYAKQYRIEVHQWSYGRLIETTKSKANQGGIPIEQSKQPIRGSPQEEAKEIAILADQAR

SEQ ID NO: 542 - protein, 753 aa, Geitlerinema sp. PCC 7407
MPIITVECLLAASEETRQYVWSLMVQHAVLVRELLERAAQHPDFERWQSAGNLPAKAVERLAKESSNEEPPLLLEPRFSQLPDRFYKSAISTVQTTYKSWLALQHGRQQQRNRKQLWLDIVEDDLLTEYDESQLDSIIKKAHEILSQLLSEMKKEANETSEDKKVRRKKATKKKDKAQTDSEEMQEERKFISIYKLNKLYNSSTDAVTRRAIAHLVRNHSQVNEEEDPDKIPLEIEKTRIEIERLDQQLKSQLPKGRDPFGTQYQKNLEFATELPSKLSTSEEDVSEFIKWNAEEGQRRIAVMRLPKSLPYPISFGSNTDLRWFQETQERKTLKGKKTNKPRNQIIVRFQGLKNHSFKILCDRRQLPHFQQFVTDWKTYQELDRKGKADSEKCSASLFLLRSARLIWREDNRVPPKSLRKKKGKQKNNAVVASGKNVGSSSDNRKTEPWNTHRLYLQCSIDTRLLTAEGTEEVRQEEIGQIIKQLEGDSKDSRKKKAVTDNQELTAGQMADRKRKSSTLTRLNNKSAFSRPSKKPYQGQPDIVVGVSFSRHKPATAVVWDAKEDKILETQTVRQLLVDRKVQDKRGNQTIVQLKFQQYRLVGRHQRLRRNRLRRRNQERSRGMYQQSKSETNLGLYVDRLLAARIVELAIKWKAGSITLPKIENIRESVESEIRARAEKKFPGLKEAQDKYAKEFRISFHQWSYGRLDTAIRSKAARVGVLIETAWQPVSGDLQDKAKDLAQAAYYTRESAER

SEQ ID NO: 543 - protein, 407 aa, Richelia intracellularis
MTCCSIVYLLKNNCQVSLLEEEPDEYAKLRRKKEIEIERLKEQLKSHIPKGRDLTGLEWSDILEKIANSTPQTENEAKLWQASLLRKSRSVPFPVAYETSEDMYWEINEQGRVFVRFNGLSKLKFEVYCDQRHVHWFRGFVEDWETKHKGKNQHSSSLFTLRSGRLVWLEQKAKGEPWNVNRLILHCSLDTRMWSHEGTQQVINEKIVKIENTLTKVKDKGELNPKQQAFVTRQKSTLARINTPFPRPSRTLYQGKSHILVGVSLGLEKFATVAVLDAIQNKVLAYCSVKQLLGNNYKLLNRQRYQKQRLSQEPHKTQKQFTPKNFGESELGQYIDRLIAQKIVANAKTYHAGSIVLPKLGYMGEIIQSEVQAKAEKKIPGYLEGQQRYAKEYRKQVHNWSYGRLIE

SEQ ID NO: 544 - protein, 807 aa, Phormidesmis priestleyi
MVASKPKPLGNKKKPDELKKRQQPKESWKTVCCCLCADESTRKFLWEAMERYTLLVNLLSKQVGHAPEFEQWKRQGWISEKAVVALCNALKQEEQFKGLPSRFYMSAQSMVKDTFEGWVKSQQRLSRKISGKKRWLKSVEEDIDLAKTTDFSPEVIQNRAKEILSELHHQETPAPQSSEISDDSPDESQQEDEDSNSQRSILSLLFDRYKVTEDYLSRRAVVHLLKNGCEVNEEIEDPEKLQQRLATKREEIQRLEAQLASRLPKGRDPTGEKANNFLKEAIQFPKHRNCYPELFLFDIFYHYALLPMPSVQYAVYLLQAILIESNVVESEFSAWQEAMTERLSNAAKIPNSLLYPLIFGSTDDLYWSFESKEKNQHDSELGKPCEGTKSRKRPSKRKRKQLKTRSEERIYVRFKGLSDYNFKIACDRRQLPIFQMFTRDWLSNKKLDKEKKSSLGLFALRSAKLIWQEDKQLLHKKGKSKQASSEELDTSSQESIPRWKTHRLYLHCSIDSDLLTAEGIEKVQPRKISETSKNLDNARKKEQELLAQVSNSNLTEQDKQELENELIKKRKKILSCKTSLVQLNNPPPRPSKVPYQGEANITLGVSFCRQELVGVAVVDLQTQQVLEYYSIRKLLTNQRVKKSRRNRSLLQLQLEKYRLVNRLRKLRRHNLVDRQEEQKQARYVESKAESNLGQYLERVIAAKIAQVALEWKASSVVIPNLGDMGEYIESAVQARAKQLFPNHRERQKNYAKQFRVGGHRWSYRRLTEFIHSRTLSEGISIKAGRQPATGSLANKALKTALSGHNFV

SEQ ID NO: 545 - protein, 668 aa, filamentous cyanobacterium CCP4
MVTYTALVNELLELVSQHPKFEVWRQQGKITRDEVKSILRPLKQNSVYAALPGRFFTSAELMVTYAFKSWLALQKHRHHQMVGKLRWLQVIEADLQAMPTSDLSLEVVQARAQQVLEHAEQSTDTQQGRSSFLSRKGKRRGNPLMGFLLDAYEAASDELERRAICYLLRNDLKVVEEDENPEVIQFRIDRKRIEVERLQDQLQSRLPKGRDPTDERYLEALGAAIALPDVDLSPIDEEDWSQWKAQKQLPLLNPLPYPILWGSSSDLRWSIIANSEADGQPSKRRKSSKRPKEKIQVQFNGLGKHTMSIQCDRRQLPVFKQFAEDYITHESTAEEDKFGMSLFALRSACLVWKKDPQAAVKRRKHKQKAKAQLDKITDYDAPWQTHRLYLHCTVDTRLITKEGSEQVRREKASRAEKLVAASVGKELTKTQQKNLKSNKTSVERLRRQPPERPSANLYHGNPDIVVGISLSRHEPVTAVVLDRSTDRALACQRTKALLKVRSIKKTYPNRSLLQRQKEQCRLVNRWRSQRRYNLSQRPEDQKHDNYRQQDAESALGDYLDRLLAARVIQLAQKWQAGSIVLPSLGNIREIVESSVQAEAERRYPKHKELQDKYAKQYRLEFHRWSYGRLLKYLKECARQHGLTIRQERQPKQGSEQEKALALIASAFL

SEQ ID NO: 546 - protein, 655 aa, Nostoc flagelliforme
MSSNSKKDSNSQILRTIRCDLYTSEDVLRKVWEEMTEKNTPLIVQLLKTVSEQPEFEANKESGKITKKEITGLRKSLTEDSGRPYSSVDNLVKQVYSSWLTLYQKRKQQKEGKEYFLTHILKSDIELVEESNCDLSTIRSKAQEIIRKPEEFLNEINPKDTNNRQRKSSQKGRKKQHKSKEENKNFENSNTEASLTKDDSKSLTDTLYKIHRETKNILTRCAVAYLIKNDEKISNLEEENTKSLEKRRTEKEVEIKRLEKQIQNTRLPNGRDITGDTYTKAFDNLINQVPKDNDECAIWIANLLNKISSLPYPIHYVYSDLTWYKTEEGNIMVYFNGWKDYKFQICCNQRQLHLFERFLEDHKVFKKSEKSGEKLSASLFTLRSVQLLWQQKEPNKVRLRRKDKSEKVKLKYASPSPKPKSQNTTEVKNSDPNRIESEPWKVYKLALHCTYDARLWTAEGTEEARKQNVDKTQKQINQAEENENLDEQQQKQLKKNKSSLSRLNNSFLRPSKPIYQGQSNIIVGVSFHPVELVTLAVVDINTKEFILNKTAKQLLGDSSYLLSRRRRQQVHFRKKREQAQKKDSPCNIGESQLGEYVDKLLAKRIVGVAKQYQASSIVLLRSKNITEIRTSIIQAKAQTKFQGGRIMSISNTYSQ

SEQ ID NO: 547 - protein, 755 aa, filamentous cyanobacterium CCP2
MVKYTLLVNRLLEQVGQLSEFKQWQEKGSISKEPVKQLCDALKKHHAEFQGLPHRFYISAKLMVTYTFESWLALQQRRRRKIDGKRRWLNRVEDDIELAKVTDFSPEMIQNRARKILAEIHPSNPVEPEPETSSDNEINEGENCQEEEEMNQPKSLLSCLFDLYDSTEDALTLRAIVHLLKNNGEVNEEDEDPKKLELRLAAKREEIQRLEKQLQGRLPKGRDPTGETTTRFLEEAIKLPEHPTAYPPRFLLNAFYCYALLPMPYIQYGVYLLNAILDEARIVESDFITWRDTIAEHLVNAAKRPNSLPYPLIFGSTSDLVWESESKRKGPNAPDTEGALEQSGAKSSRKRPSKRKRTRLKTQSDERITVRFHGMSQYRFKIYCDRRQLPIFRQFLTDYCTHKALDEENKFSMGLFALRSASLIWKKDKQRPHKRNSSEPVEPLSPWQTHRLYLHCSIDSRLLTAEGTEQVRFQKILQTKRKLEGAKNKEQEILRQKSERQHTESEQDLDDKLKKQRQNVARNQTSLNCLYNPTPPRPSRVRYQGNPNIAIGVSFCRQQLVGVGVIDLQTQQVQEYYSIRRLLINRKVTQVKRGRSVLQLKLKKYRLVNQLCMWKKKNITQRTQQQKQGLCIQNTTESNLRQYLERLVADRIVEVALKHQAGSIVTPQLGEIRESIESAVQAIAKQLFENHREAQQAYAKQFRMDFHRWSYGRLTDCIHSRARQEGILVQAGRQPVEGNLVGKALTIALSGRNLV

SEQ ID NO: 548 - protein, 726 aa, Chamaesiphon minutus
MSLITFPFRLDALGKTPKDREQVRRYFWELMTQQHTPLINRLNLLVAEHPKFANWQIKNTVDADDLLCLWRSLKKQPQFQGIPDRACVSARLVTHNTYESWLALQADRQEKLTKLLNSVEILKPDVELIAIGSCNLDVIRNRAKEVLSEVNTQISNDSEKKKSQKAIEGGIYKILYDKHRKTDDLVEKCAIAYLIKNRFKINSDETEEDVKKLNARRHTKQKEIEIIQKQLHSRLPKGRPWAGRDIFGEIASIDVRETEWNSIESALLKQQTFMPHPILFESSDDLIWAEPEKFQLKDLQVEAGKSGSTELDEFQNENFQGEQANSVESRKRVCVGFKSFEEKYAFEVAGDYRHIHAVWQALKERKIYDKNIDENTSALFLVRSATLIWRDYKKNENRIVRRRKANNKRSKREGGTAGTKPDSLRAPAFYDPEFPWNRYQLFLHCTIETLYVSKEGTELKLEMQKKPITKALQTLEKNITESEEKGESTKNRKDRHSRQSGTLRRMECYDDNYERPSKSLYTGQPHIVTGIALGASGLVTATIVDTSSGKILECRGRKALLGKQDRLVNRRQFQRQLNMRRRTQNQRRGANNQFGEANLGDTIDRHIANAVVDFAKTYQSGCIVLPDMEDYRRRKQSEMAALAERECSGWKGVEKKFAKAQNVKIHSWSYGRSIEYITNQAEKEGMLVKIGRQPIHGSSQEQAKQMAIEVYQDKTKFKQSLSNQSA

SEQ ID NO: 549 - protein, 813 aa, filamentous cyanobacterium CCP2
MNELEEGAGFNETVLCKLGADEKVRQDFWQWSIKHTLLVNELLIQVSQHKDFEQWKNSGTITKKAVVELGKPFKDPEREQFIELPYRFHTSATLLVFYIYQSWLKLHQKHSYKLQGKKKWLAVLDNDLEVAKHTDFSPQMIQTQASEILSQASAQHEKSQQKRKKKSSKKSGETSKSHLAIMTILFDRHEQSQDLLERRAIAHLLKNGCQVNDAEEDLEALKLRLEKKRIQIARLEKQLERRLPDGRDPTGERFASNLAQAIAFADHLTFVPAKFWINWYQVLQRNPNDESDLVIPFLGYVYHQQAGDAGFDAWEQGDSERAALVSTLYETLPYPILFGSAGDVYWSLKQVDPNPGTTRQKQQSHRTPKRRRKPKHKQKVQERLCVRFKGEELKNHHFGVYCDRRQLPVFKQFLTDREVQKQRKDTEKFMGGIFTLRSARLVWKEDTERLQRKRASTTSLLWLKFLFAMQREETVTDKELDSWIISFLCINTIFPWQSHRLYLHCTIDSRLLTAEGTKEVIAQKTAATQQYLEQFKPETATPKPQAVERVEEERQTPQARGGTTVKKKETTLARSKNPPPARPSRLLYKGRSDIAAVVVVSRFAIVAVAIVNTQTQEILEFQKIKDLLTEHRSDVLEERLKKHQGMLKGGRSLEQLQLQQYRLVKRWRKHRKKNLTQRQEEQKRGLYKRSNQESNLAQYLNRLLAKRIVQLCQTYQVGMIVLPELGNIGENFECEIQAKARQKFPGDNVQLQKQYLKELRMRMHRWNYKNLLHAIRQYATPARIPVTTRWQPKEGALRDKAAVMARAVPPGVP

SEQ ID NO: 550 - protein, 397 aa, Geminocystis herdmanii
MGRNLTNDSWLEILNFVSDTIPQTDEEAKQWQDQLLRQSKSVPYPVMFNTNEDLRWSKNKKGRLCVTFNGLGKLVFEIYCDQRQLKWFERFYEDQEVKRKGKNQHSSSLFTLRSGMLLWQEHEGKQEPWQNNHLTLYCALDTCFETAEGTELVRQKKVKEVVNLIDAMNNKSERTKTQDAFIKRKQSTLARLDNSFPRPSKPLYQGNQNIVVAVSMSLEYPATIAVFNMSSQEVLTYRSTKQLLDNNYQVLNRQRKQKQRLSHQRHKTQRQNSSDFFTQQESELGQYLDRLLAQSIVSIATQYQASTILLPNLKNIRDSIQAEIEAKAEAKIPNCKEAQKKYLKNYRINIHHWSYGRLIDSIQLQALKLDILIQEVKQPIRGSPQEKAKQMAILTLE

SEQ ID NO: 551 - protein, 397 aa, Geminocystis sp. NIES-3708
MGRNLTNDSWLGMLNLVSNTIPQTDEEAKQWQDQLLRQSKSVPYPVMFNTNEDLRWSKNKKGRLCVTFNGLGKLVFEIYCDQQQLKWFERFYEDQEVKRKGKNQHSSALFTLRSGMLLWQEHEGKQEAWQNNHLTLYCSLDTCFETAEGTELVRQKKVKEVVNLIDAMNNKSERTKTQDAFIKRKQSTLARLDNSFPRPSKPLYQGNQNIVVAVSMSLEYPATIAMFNMSSQEVLTYRSTKQLLDNNYHLLNRQRNQKQRLSHQRHKTQRQNSSDFFTQQESELGQYLDRLLAQSIVSIAKQYQASTILLPNLKNIRDSIQAEIEAKAEAKIPNCKEAQKKYLKNYRINIHHWSYGRLIDSIQLQASKLDILIQEVKQPIRGSPQEKAKQMAILTLE

SEQ ID NO: 552 - protein, 364 aa, Cyanothece
MLKRLQEQINSRLPQGRDVTNENWLETLKIACCTDPENIEEARSWQDNLLTKSSSIPFPINYETNEDLTWSKNEKGRLCVQFNGISDLKFEIYCGNRQLKWFQRFYEDQQIKKSSKNQHSSALFTLRSGRILWQEETGKSQPWNVHRLTLQCTLDTRLWTQERTEEVKQEKAEEIAKVLTSMNEKGDLTKNQQAFIKRKQSTLDRLENPFPRPSQPLYQGKSNILVGVSMELKKPATIAVIDGMTRKVLTYRNIKQLLGKNYPLLNRQRRQKQLQSHQRNVAQQKEAFNQFGDSELGQHIDRLLAKAIISIAQEYQAGSIVVPKLKDIREAIQSEIQTKAEAKIPNCIEAQAEYAKKYRIQVHQ

SEQ ID NO: 553 - protein, 393 aa, Nostoc carneum NIES-2107
MSQKTIQCRLIASESTRQKLWKLMAELNTPLINELLEQLSKHPDLEKWRKNGKLPSNVVYQICQPLKTHPSFKGQPSRFYLSAIHVVDYIYKSWLAIQKRLQQQLDGKLRWIEMLNSDAELVEISGCSLEAIRTKAAEILAMTTLESSSNTSVTKTKNTKKSKNSNSSASNSDRSLSHKLFDAYQETDDILSRSAISYLLKNGCKLNNKEEDPEKFAQRRRKVEIQIQRLTDKLTSRIPKGRDLTNSKWLETLFTATTTVPEDNTEAKRWQDILLRRSSSVPFPVVFETNEDLVWSTNEKSRLCVHFNGLSDLTFEVYCDSRQLHWFKRFLEDQQTKRKSKNQHSSGLFTLRNGRLAWQQGEGKGEPWQLHRLTLYYRQDRCAPSNKGADVLL

SEQ ID NO: 554 - protein, 781 aa, Leptolyngbya ohadii
MAIKTLRLLLCFDENTRKQLWDLSVRHTLLINQLLVELPKQSKFESWRKKGSIPRKEIQLQLTHLKNKKFVHLKEEGVFEDIPARMLTSAVLSVQYMFASIFARQRKLHFQCEGKKTWLAIQEYDLDLAQSTDFTPEQIRDRAKQFLEEVEQRRQELREENQAEQDLPSVMSLLFQLFKETETPLEQRAIAYLLRNDCKVKVKKKKKKEGGEVEEAEVEDRDAILLRLSKKRIQIQRFEEQMAVELPIGRDPLGYRTDQLIQSAALFYPEGEFEAWQKEFAVRLANLSSDLETLPYPVLFGSNTDLYWSFETNTQPEEPKTSLCEIVNPNGTPSSRRKPKRRRYKKRKKLNTARICVRFKGFSGIQGKTYCDRRDLATLRQWVTDLEENKRRSKEDKFSLALLPLRSACLLWEPDKQHAGEEKPWQSHRLYLHCTIDTRLLTAEGTEQVRQEKLTKVNRYLRQLRIEEQADEILSCSPPPIDDEDEEQVVIENEENTQINKKNRTTRDRLIRNSPPPRPSQVAHRGDPDIAMKIAFSRQEIVGTAVMDLQSQQVLEYCTPRELLSEQRQEVLKQRSAKLHSQPKRQQKAQDKAEAVQQSEGKKSCSPYKPKINPKQLQLQPYRLINRWRRLRDQNIRDRQTEQQQGLYRPSKAEANLSQYLNRLLARRIIQRCQHWKVSIIVLPELGDLRESVESEIKAKAKQKFCDDNVYRQQQYKKEHRMGFHRWSYKNLSQCIRACAVEVGISVVPGRQPRLGTLQEKVIAVSSDRLPRPESVDSPAA

SEQ ID NO: 555 - protein, 356 aa, Scytonema hofmanni
MNWLNLKNKPGRIFVKFNGLKKNIINPEFYICCGSRQRNYFQRFCQDWQVWHDNEETYSSGLFFLRSARLLWQERKGIGAPWKVNRLILQCSIETRLWTEEETELVRTEKIVKTEKTIRKMEQERDLTQKQLTHLQRERTQRQKLNNPFPGRPSQPLYQGKSNIIVGVSFGLDKPATVAVVDAANNKVLAYRSTKQLLGKNYNLLNRQRQQQQRLSHERHKAQKQFALNDFGESELGQYVDRLLAKEIIAIAKTYKAGSIVIPKLRDMREQISSEIQSRAEKKCPGYKEAQQKYAKEYRMSIHRWSYGRLIESIKSQAAKAGISTEIGTHQIRGSPEEKARDLAVFAYQERRAALV

SEQ ID NO: 556 - protein, 800 aa, Leptolyngbya ohadii
MRTITFRLCASEETRKIFWYLCQEHTLLVNALSHKVQQSKEFQTWQEKGWLPNKKLKLLNKEVLEEKTAFQVQVLDQTKLPDLPSRFIASAIRANQQTWGSWIAQQRRRYMSLTGKQDWLQLQECDLDLSQTTDFTFAQICTEVREVLASVTAQIAAEEQKKQNQKKRSRQTTKAKRTVKKQKKVSESRRITEALFKLLKKKQNALTMRAIAYLLRNNATVQEDEENPQEIALKLDQKRIEIERLKTQLQSQFPKPRDPTGAIADRYINEALEKPSFATSWKILVLFCLLITNQELPGLSLQFHSHLLQQLQHPDLSREAQQAEFKSWEEGCLERMTKLATVLKSLPLPISFDSSDDLYWSVEPKQQKAVEPKETTPAPTDGQPRRSPKRKRKNRRKIQVQERIVVRFKGLREHKFGVQCSHRDLAILQQCQREWERYGSLPDDKKFSLGLFPARAARLLWRKDKQQRKPSANSPGEKSQVEEWRQYRLYLHITIDDRLLSAEGTEEVRQEKLIKAQDDQKTMRKRKSPRKKLEEAELTQEQKEKKAKDGAIAKKRVASTQARLSDPTRLKRPSRKPYQGQSHIQVRVCFNQQERVSLAVFDTQQQQVLEYVSVRDLLYDHSAEKHHQHFISNPKRKGKRTLEQMQLEQYHLLDRLRKQQVKNHQRRMRAQKQGYYKYSKSESNLGEYLDRLLAARIGQLAVQWQASSVVIPDLGNLRESVEAKLQAWADLIFPKMEEVQQKTTKKIRVSFHGWSYGRLARCIRSRAARDGLAIVIGQQPQQGSLQEKARAVAPANSTTA

SEQ ID NO: 557 - protein, 735 aa, Nostoc sp. NIES-2111
MSVITIQCRLVAEEDTLRTLWELMANKYTPFINELLVQLGQHPEFETWLKKGEVPKETIERINKSLSTQEPFAGQPGRFYTSAITLVKEIYKSWFTLQQRRLRQIEGKERWLKIFKSDIELQQESQCDLNIIRTKASEILNSCAEQLTQDKNQQSKKKGKNTKKNKNESSASTLMNLLFNLYETSDDCLYRCAIAYLIKNNCQVSYLEEEPEQYIKRRHRKEIEIERLRDKLKSRIPNGRDLTGKDWLSTLNKVNNEIPKDENEFKLWQKNLLKVHNSMPFTVDYRTNTDLDCLLGFLNKETNIQKIILCQMYCLKLALKEGLYSFIKYLFADVNSILDKSNELLELLQHSNNKHLIWQLYLMKLSLKSGLDTFIKYMYAKILNLIYKQCKYLVQFNGLKEELNSPEFYICCDKRQLHYFKRFYQDWQNWHHNEEKYSSGLFLLRSARLFWQERTGKGKPWQIHHLILQCSIDTRLLTKEGTEIVRLEKINQADKTISNMEKKGELSKNQLSRLKRELTTRQKLNHSFPDLPSKPLYQGKPNILVGVSLGLGKPVTLAVVDAANQKVLTYRNVKQLLGKKYNLLNRQQQQQQYFSHKRHKAQKDNAPNSFGESELGQYVDRLLANAIVAIAKTYSAGSIVLPKLRDMREIIQSEVQARAEEKIPGYKKGQQEYAKQYLISVHRWSYGRLIETIESQATQAGILIEISSQPSRGNLLDKARDLALFAYQERQLAIV

SEQ ID NO: 558 - protein, 493 aa, Cyanothece sp. PCC 7822
MPTSSKTAIKFEGEPEDKEAYLLRRTQKEIQIQRLEAQIHSCAPHPRLNDDSLWLDALNQSLTGITEVKDLQQIQRQLLQKFPHLPYPVFYNTNTDLEWSINHQGRIRVSFNGLKKKGITLEIACDERQLPYFQRILSDYQCFKRKDLPVPVPGGLMLLRSAQLIWKPIEGKGQPWNTHHLYLHCAINNQLWSKTGMANIQQELIQETQKQLNKCFAKEEQNPLTNNQKKNILRLESSLQRLKTFDIAYLNPFQSHSYQGNPHIIVGVAIGLKTPITIAIVDLQTQATLGFRSPKQLLKRRRQILVAKAKTEDKIRFSPRKKREITDYELFQDYLHKKHSNKHERHKAQKKFADTQFGEANAGLYFNRLFAQAIVEVAHSYQASVIVLPDLTNIREAIESEVRARAELKYPGNKTQQQRYAKDFRVTVNQWNYNQLGQCINYAAKKAGLKIAILKQTIKGSSQQKARQIALTYWEKQQQTQTPFNVQTPNNLV

SEQ ID NO: 559 - protein, 311 aa, Cyanobacterium sp. IPPAS B-1200
MKKANKNKFSSALFTLRSAMIIWKEDDGKGELWDKHKLYLHCTLDTDYWTVEGTQVVAQRKQKEVLNIIDGMKEKDDLRDTQKKFIQRKQTTLARLNNIFPRPSKSIYQGNPDLYMGVAMGLQEPVTIAVVDVGEGKAILHRNIKQLLGDDYHLLRRRRNEKQKLNHQNHKARKRANFQQKGESNLGEYVDRLIAKSILKIAQEYEVSTIIVPRLSQMRSITEAEIQLRAEERIPEYKEGQRKYAKDYRVQVHQWSYGRLIDNIKGNSSKLGIVVEEGTQPKQGTFTDKALQLALSTSKTNHKANPTKINS

SEQ ID NO: 560 - protein, 443 aa, Nodosilinea nodulosa
MFKLYDETEQSTSRDKAAIIYLIKNGCKIPSCQENPKKFEENRLNKQKSIERIERKLEGKTPKIRKFPLYPIAFYSSDDLRWSLIKREDPKTKDIKERIFVTFKGMGRNRIFEICCGRRQLPIFQIFLEDWQLYQGNEKEYSLDMVLLRSASLVWRKCKESSSKEAANSLMDAYEPYLKVTIDIDNLTTEGAGVIRDEKLKDVERRIQNYGKLAEDKDLTPNQKTNLKQLKSRETGLGNCFPRPSKPAYEGNANIAIGISFCRQKVIAAAIVDLKKGKAIVYRTAQQLLGKDYSQIPEYRHRQRTNRNKRRKLQLQGKNASITEAGQGVHLNRVLAKAFVRLAEEYNAGVIVLPKTDGLREIIQSGIEAMAEQKYPKDKSRQRQFLKEYRISVHNWDYFRLRRSIEERAAKVGIPVKVGCQPSKGYLPQKAQQVALSVLERVV

SEQ ID NO: 561 - protein, 292 aa, Cyanobacterium sp. IPPAS B-1200
MIIWKEDDGKGELWDKHKLYLHCTLDTDYWTVEGTQVVAQRKQKEVLNIIDGMKEKDDLRDTQKKFIQRKQTTLARLNNIFPRPSKSIYQGNPDLYMGVAMGLQEPVTIAVVDVGEGKAILHRNIKQLLGDDYHLLRRRRNEKQKLNHQNHKARKRANFQQKGESNLGEYVDRLIAKSILKIAQEYEVSTIIVPRLSQMRSITEAEIQLRAEERIPEYKEGQRKYAKDYRVQVHQWSYGRLIDNIKGNSSKLGIVVEEGTQPKQGTFTDKALQLALSTSKTNHKANPTKINS

SEQ ID NO: 562 - protein, 632 aa, filamentous cyanobacterium CCP1
MTILFDRHEQSQDLLERRAIAHLLKNGCQVNDAEEDLEALKLRLEKKRIQIARLEKQLERRLPDGRDPTGERFASNLAQAIAFADHLTFVPAKFWINWYQVLQRNPNDESDLVIPFLGYVYHQQAGDAGFDAWEQGDSERAALVSTLYETLPYPILFGSAGDVYWSLKQVDPNPGTTRQKQQSHRTPKRRRKPKHKQKVQERLCVRFKGEELKNHHFGVYCDRRQLPVFKQFLTDREVQKQRKDTEKFMGGIFTLRSARLVWKEDTERLQRKRASTTSLLWLKFLFAMQREETVTDKELDSWIISFLCINTIFPWQSHRLYLHCTIDSRLLTAEGTKEVIAQKTAATQQYLEQFKPETATPKPQAVERVEEERQTPQARGGTTVKKKETTLARSKNPPPARPSRLLYKGRSDIAAVVVVSRFAIVAVAIVNTQTQEILEFQKIKDLLTEHRSDVLEERLKKHQGMLKGGRSLEQLQLQQYRLVKRWRKHRKKNLTQRQEEQKRGLYKRSNQESNLAQYLNRLLAKRIVQLCQTYQVGMIVLPELGNIGENFECEIQAKARQKFPGDNVQLQKQYLKELRMRMHRWNYKNLLHAIRQYATPARIPVTTRWQPKEGALRDKAAVMARAVPPGVP

SEQ ID NO: 563 - protein, 282 aa, Phormidesmis priestleyi
MAWQEGRGEGEPWNLHRLVVSCAIDTDSWAQEGTEQIRQKKASECAEIIACNKVKKNLSKDQEAFLKRRETMLALLDNPFPRPSRPLYQGQPSILAGVSYGLDKPATLAIIDIQTGKAITYRSIRQLLGENYKLLNRYRLQQQRNAHQRHKNQQKGAFNRFGESNSGKHLDRLIAHEIVAIAQKYQVSSLILPDLSDIREIVQGEVQARAEQEIPGSIELQRQYALQYRASVHRWRHAQLSQCIGSQAAQVGISIEVVKQPFTGTPQEKPKNLAIAAYQSRK

SEQ ID NO: 564 - protein, 529 aa, Lyngbya confervoides
MERRAICHLLRHDLKVIEEEDTPDTIQHVIDRKRIEIERLTEQLQSRLPKGRDPNHERFVEKLEIAVALPDCSPEHWDPEEFDEWRIQKQISELNTLPYPILFGSASDLYWDILDNTTSATTVSAQKKSRKSKRPNERLQVRFKGLDEHKLRIQCDRRQLKIFRQFSTDYISNKLLPKDEKFGEGLCALRSACLIWKADPEASANRKNRQKASLRKDSRLRELLEQNKVCLIDYPWETHRLYLHCTFDSRLLTQQGTEQVRLQKLEAAQKSVEKIKERQAGDPSITLTENEKARFKAKQTSISRLERNRPPERPECQIYQPNPNIVLGVSLSRHEPVTVVVFNKEKNQVLECCSTESLLKRRGIISPRNKQSIVKLQHEQQQLLRRWRRQRHYNLYQRPEEQKQGDYHQHDAESQLGDYLDRLIAARVTELAVRRQAIAIVLPGLQNIREGVESDIQARAKKKHPHHKKLQAQYAKQYRREFHRWSFGRLGQYITEAAKQQGIVIYKGWQPKHGNEQEKAMAVITSATT

SEQ ID NO: 565 - protein, 286 aa, Geminocystis sp. NIES-3708
MIIWKEDDGKGELWDKHKLYLHCTFETYCLTAEGTSAIAQEKQEEVTKIINIMKAKEELTDTQKGFIRRKNSTLGKLNNTFLRPSKPLYQGKSNIYLGIAMGLEQPVTIAIVDIETDKVITYQNPKQLLGVDYRLLRRQRTEKQKLSHQSHKARKRFNFQQKGESNLGEYIDLLIAKAILTVAQEYQVSKIIIPRLKDMRSITEAKIQLRAEKRIPEYKEGQKKYAQDYRVQVHQWSYGRLIEHVRAIALKVGIVVVEAKQPKQGTFTEKALQLVLSNTEKNLKKK

SEQ ID NO: 566 - protein, 287 aa, Nostoc sp. 'Peltigera membranacea cyanobiont' 232
MLWQQGEGKGEPWKVHKLALHCTYDARLWTAEGTEEVRKEKTDKAQKRVSKAEKNEKLDNAQQTQLNKDKSSLSRLNNSFNRPGKLIYQGQSNIIVGISFHPIELATIAIVDINTKKVLACNTVKQLLGNGFHLLSRRRRQQVHLNKERRKAQKKDSPCNIGESKLGEYIDKLLANRIVEIAKSYQAGCIILPRLKDIKEIRTSAIQAKAETKIPGDVNGQKLYVKEYNRQIHNWSYNRLQESIKSKAAELKISIEFGIQPHSGTLEEQARDLAFYAYQSRNHTLGR

SEQ ID NO: 567 - protein, 330 aa, Phormidesmis priestleyi
MSFITVQCRLVASEEIRQQLWHLMADKNTPLVNKLLKSVSQHDDFEVWQRNGTVPDKSVRELCNPLKVHPQFEEQPGRFYTSASLIVTYTYQSWLELQRKRRRSLDGRQRWLNVVKSDAELVQMSGCNIHTIQNKAKEILAQLNVQSPGAQNQPKQKRKKKQNSKANGDLMSALFQAYETVDDALSRCAIAHLLKNDCQVCEQEEDPEAFAQRIHGKQRRIKELEAQLASRLPKGRDLTGEEFLEVLSTATAKVPDDTIEQMLWQAKLLAKPATLLYPIIFGSQTDLRWSTNEKGRICVAFKAREQTRGGTLASKLPHLTLLFRYSALEG

SEQ ID NO: 568 - protein, 300 aa, Scytonema hofmanni
MSVITIQCRLVAEDDTHRQLWELMAEKNTPLINELLEQLAQHTDFDKWLKQGEVSKEAIETIQKSLITQERFAGQPGRFYTSAVTLVKEIYKSWFALQQQRQRKIEGKERWLKMLKSDIELQQESQSSLDIIRNKANEILNSFVAKFTQPIKQPSKTKKGKKKKKTKDSTLFKALFDLYDKTEDSLSKCAIAYLLKNDCQVSELDEEQVQYAQRRRRKEIEIQRLREQLKSRKPKGRDLTGEKWLTTLEEATNQVPLDEFEAKSWQASLLKVTSDIPYPVDYETNTDLDWLIYSYPFRGG

SEQ ID NO: 569 - protein, 269 aa, Lyngbya sp. PCC 8106
MSIITVHCRLVAPQNVRQQLWKLMSDRNTPLVNELIAQISQHPDFETWRRKGKIPAGIVKKLCEPLRSDPRFEGQPGRFYTSAISLVDYIFKSWLAVQQRLQRKLDRKIHWLSMLKSDEELVAESNHTLEEIRAYATEILSSVETQKNQPSPKKSPRKSPRKGKIKKNKGSQSPTDILFETYNKTEDILSRSAICYLLKNRLKMSEKPEEIEKFSQRYRKKEIEIQRLKEQLEGRLPQGRDLTGQKWLETLITATTTVPKDNPEAKSYY

SEQ ID NO: 570 - protein, 260 aa, Leptolyngbya boryana
MNHLALYCTFDTRLMSAEGTLEAQQEKVAKTLKKLTHPNPDPRNHSTLDRLQNLPERPSRTPYVGNPEILVGISIGLADPITVAVVNGRTGEILAYRTPRALLGEQYHLLNRHRKEQQHRLQRHKNQQRGVAYQPSESELGQYVDQLLANSTIDLARTYQAGSIVVPNLKNVRDLLASEIQARAEQKCPGSVAAQKQYAKAYRQAIHQWSYNRLIQAICSQATQRGITVEVGSQPLKGNPQELAKDIAIAAYYARAITAK

SEQ ID NO: 571 - protein, 211 aa, Phormidesmis priestleyi
MLALLDNPFPRPSRPLYQGQPSILAGVSYGLDKPATLAIIDIQTGKAITYRSIRQLLGENYKLLNRYRLQQQRNAHQRHKNQQKGAFNRFGESNSGKHLDRLIAHEIVAIAQKYQVSSLILPDLSDIREIVQGEVQARAEQEIPGSIELQRQYALQYRASVHRWRHAQLSQCIGSQAAQVGISIEVVKQPFTGTPQEKPKNLAIAAYQSRK

SEQ ID NO: 572 - protein, 453 aa, filamentous cyanobacterium CCP1
MVKYTLLVNRLLEQVGQLSEFKQWQEKGSISKEPVKQLCDALKKHHAEFQGLPHRFYISAKLMVTYTFESWLALQQRRRRKIDGKRRWLNRVEDDIELAKVTDFSPEMIQNRARKILAEIHPSNPVEPEPETSSDNEINEGENCQEEEEMNQPKSLLSCLFDLYDSTEDALTLRAIVHLLKNNGEVNEEDEDPKKLELRLAAKREEIQRLEKQLQGRLPKGRDPTGETTTRFLEEAIKLPEHPTAYPPRFLLNAFYCYALLPMPYIQYGVYLLNAILDEARIVESDFITWRDTIAEHLVNAAKRPNSLPYPLIFGSTSDLVWESESKRKGPNAPDTEGALEQSGAKSSRKRPSKRKRTRLKTQSDERITVRFHGMSQYRFKIYCDRRQLPIFRQFLTDYCTHKALDEENKFSMGLFALRSASLIWKKDKQRPHKRNSSEPVEPLSPWQTHRLY

SEQ ID NO: 573 - protein, 825 aa, Leptolyngbya frigida
MQMRTIKTDSIVRITQRRKRKGVTEDLPSFDEAAWCRLCEFSYKHTLLVDTIVSQIKQHHKLINWIRSSQELQRQDDTTQETEAKQGQNGLPEGLVKALCDALASTPQFSKMSGRFYTSAIDRVEELFKGWFAAHQKLIHKIRGKRRWLAVVESDAALAETSNFSQQEIEIRAAQILAELEAHNGTNAGSNDHVDFNTLFQKFDETEETLARRAIIHLLKNGGKTHAEVKKPRKRKRKGKSISTQPLTLTERLEAQRVGIERLEKQLLGQLPRARNLFPEQAFEHHLEAVIAMPNSDATELERYYFLYFSLLLYLADANEYLQLERHLLTTLVLQWSKLGDLHYYRVLIYAFMLHAASAQQYLQLGSYLLQTIKLEAERVEAAFFAWHESITPKLHDFLREPKALPYPISFGYDDVRSWQMNQKGKIFFKLNGWGDLLFEVRCHHRQLPLIKTFLKDWQTKNASERKAQSSKKDPFTGSLMLLRSIELIWKPKEASDQKDAQLCSHCEVFQQSSEQGFWNECKLTIHWTFNAEALTRQGSEKMRQRKLELQLQQLQAKQAKLEQQQDRLDKLEQAAPEAAKSQEQLKRIRNLKKQIQQLQEDLAKLRPKLACLQAAQPFGRPDRPLYEGVPNIFVGVLLDLDTHLAVTVVDAMRRKRLALRSAPKISSEGYRLLQKYFRQRQEHSKQRQEDQQAQRYSHQTESGLGQQVDRLFAKGLVELAQAYKASTIVIPIKGGWRERLYSQLVARAKLKCNGNKQAMARYTKAHGERLHQWDYNRLSQAITDCAATHGIEVVLQKTVFETDVFQQAANLAIAAYDSLNSAQT

SEQ ID NO: 574 - protein, 246 aa, Leptolyngbya boryana
MSAEGTLEAQQEKVAKTLKKLTHPNPDPRNHSTLDRLQNLPERPSRTPYVGNPEILVGISIGLADPITVAVVNGRTGEILAYRTPRALLGEQYHLLNRHRKEQQHRLQRHKNQQRGVAYQPSESELGQYVDQLLANSTIDLARTYQAGSIVVPNLKNVRDLLASEIQARAEQKCPGSVAAQKQYAKAYRQAIHQWSYNRLIQAICSQATQRGITVEVGSQPLKGNPQELAKDIAIAAYYARAITAK

SEQ ID NO: 575 - protein, 252 aa, Phormidesmis priestleyi
MEQKRQEGISRLKKQLEEAKDPEELTEHQQAYLKRQQSTLTRLQCLPQRQGKPRYQGQPDIFVGVSIGLINPVTVAVVNVRTGHVLAYRSVRQLLGDNYRLFNRHRQQQQQNALKRHKNQTKGYTHQPSESELGQYVDRLLGKSIIELAQQFQASGIVLPHTQNLREHLAAEINARAERKSDSKQVQNKYAKQARISIHRWSYDRLLTAIRAQAEKADMTTETATQPRQGTPQHKARDVAIAAYHFRQVSSN

SEQ ID NO: 576 - protein, 204 aa, Calothrix sp. NIES-4071
MRYLQTGNLHILVGVSLGLKKPATVAAVDVVSNKVLAYRSVKQLLGQNYKLLNRQRQQQQRLAQKRHESQKKQAPNQLGESELGQYLDRLLAKSIINFAVTYQASSIALPKLRDMREIIQSEIQAKAETKISGYKEGQQKYAKEYRMSVHRWGYGRLIDNIQAQAAKAGITIETPSQQTKGSPQEQAKDLAICAYKKRQAMLNK

SEQ ID NO: 577 - protein, 222 aa, Geminocystis sp. NIES-3708
MICYHTNTFNKTFLLVMAHVTIQCRLIASGDTRQFLWQLMTEKNTPLINEILLRIKQHPDFPDWRIKKKLPKYFLARQIAELKNNYPFEGQPSRFYASVNKIISYIYKSWFEVQKTLDWKLQGNVRWLEMLLPDTELIKHFDNSLESLQQQATLILDSIDSTVNKDQISTILFEKHDKTKKPDIRSAIIYLLKNACAIPKKPETTEKYQDLKRKVEIKITRL

SEQ ID NO: 578 - protein, 324 aa, Anabaenopsis circularis NIES-21
MTRYCQNNSTQPILRTISCYLSGREEALRKAWEETAQVNTPLIVDLIKAVPEQPEFETHKETGTITKKKIKELRQSLTQDSDRTYSSADSLVKEVYASWLKLYQTRKIQKEGKEYFLKNILKSDAELVEKSNCELHTIRCKAKEILSQVEEFIDKINNSELQITQTRSAKKKNNQNNNSINTILNKLFSKKINKSVKQSLNYTLYEIHRESSDSLTQCAVAYLIKNGNKVNEAEENLVQLNKRRAAKEVEIKRLETQIQNTRLPNGRDITGAKSSQAFNNLINQVPNDDEEFAEWTATFLKKISNLPYPINYLYGDLTWYKNEK

SEQ ID NO: 579 - protein, 304 aa, Anabaenopsis circularis
MSGREEALRKAWEETAQVNTPLIVDLIKAVPEQPEFETHKETGTITKKKIKELRQSLTQDSDRTYSSADSLVKEVYASWLKLYQTRKIQKEGKEYFLKNILKSDAELVEKSNCELHTIRCKAKEILSQVEEFIDKINNSELQITQTRSAKKKNNQNNNSINTILNKLFSKKINKSVKQSLNYTLYEIHRESSDSLTQCAVAYLIKNGNKVNEAEENLVQLNKRRAAKEVEIKRLETQIQNTRLPNGRDITGAKSSQAFNNLINQVPNDDEEFAEWTATFLKKISNLPYPINYLYGDLTWYKNEK

SEQ ID NO: 580 - protein, 234 aa, Phormidesmis priestleyi
MAILQSDDELTIASQSDINTLRSKASELLMQLNHSDSQDNEPQPKKARSKKKGKKESKQPGSAISSTLFTLYGETEEVLTRCAIAYLLKNGCKLPDRFEDPKKFAKRRRKTEIRLERLIKTLERTRFPKGRDLSEHTWLETLTKAEGCVPKDDNEAADWQAKLLTEPATLPFPVNYETNEDLHWFLNEKGRLCVNFNGLGEHSFEIYCDQRVRPTAPFSSLVLYAKIFVTLRSN

SEQ ID NO: 581 - protein, 173 aa, Cyanobacterium sp. IPPAS B-1200
MTQITIQCRLIASADTRQFLWMLMSQKNTPLINEILTRIRENPDFSQWEEKGKLPKNFISQQIAELKNDSCFQGQPSRFYASVGKIIDYIYKSWFQIQRINQFKLEGNTRWLKMLKSDAELIESFDGSIEALQNQAQQILSGVDITSTQNRTADFLFQEYNKTKDPQTQSAIA

SEQ ID NO: 582 - protein, 178 aa, Geminocystis herdmanii
MVQVTIQSRLIASADTRQFLWLLMSKKNTPLINEILTRIKHHPDFPQWREKGRLPKNFIAQQIQELKNDSRFQGQPSRFYASVGKIIDYIYKSWFKVQKSYKIQLEGNSRWLEMLKPDSLLIESFDGSMEALQNQAQQILDNIETTSTQEGIVDYLFQKYEKTEDCRMRDAIAQRHRR

SEQ ID NO: 583 - protein, 139 aa, Anabaena sp. MDT14b
MSVITIQCRLVAEEDSLRQLWELMTEKNTPFINEILLQIGKHPEFETWLEKGSLPAELLKTLGNSLKTQEPFTGQPGRFYTSAIALVDYVYKSWFALQKRRKNQIQGKQRWLKMLKSDQELEQESQSSLEVIRTKVNQN

SEQ ID NO: 584 - protein, 208 aa, Myxosarcina sp. GI1
MGVSIGLQQPVSVAVINVPTGEVLLDRDTKQLLNKPVQQKPKQGKQAKRHTQYGFLLRRRQQQQENDFKRQQAQIKAGDNRFGESNLGEYVDRLLAKAIVEIAINYRVSSIVMPDLTNIREILESEIAARAEAKIPGVKKAQKLYAKKYRQNIHRWSYARLCEAIAFKAARHNIAIEYDKQVAFKTLSVMPAKDLALSVYHSRQQKHS

SEQ ID NO: 585 - protein, 264 aa, Leptolyngbya sp. NIES-3755
MPLATPIETGARSEIPKDARTKAQIRELKNLRKAIQDLQADLAKPRPKLDCLQNSPSFDRPDRPLYEGVPNIFVGVLLDLDKHLVVTVVDAMRRKVLALRNARSISKEGYDLLQRYFRQRREHSKQRQADQKAHRRVHQTESGLGQQVARLFAKGIVELAQQYKASTIVIPETDGWRDRLYSQLVARAKIKCNGSKKAMARYTKAHGEKLHQWDYSRLSQAIVDRATTDGLKVMQQKTVYEEDVFQQVANLAIAAYDFLNLGER

SEQ ID NO: 586 - protein, 132 aa, Hassallia byssoidea VB512170
MSQITIQCRLVASESSRQQLWELMAQLNTPLINELLRQVSQHPEFETWRQKGKHPTGIVKELCQPLKIDPRFIGQPGRFYTSAIALVNYIYKSWFALMKRSQYQLEGKIRWLEMLNSRPLAKVGQEDSVCER

SEQ ID NO: 587 - protein, 249 aa, Nostoc sp. 'Peltigera membranacea cyanobiont' 232
MTQKNTPLILQLLKSVSEQPEFEANKEKGEITKKEIVELRKGLKKNPEFEEQSGRLRSSAESFVKEVYSSWLTLYQKRKRQKEGKEYFLENILKSDVELVGESNCDLETIRSKAQEVLTQPEEFIKQLTINDEDVKPTKSARKRVNKNIYNKSTDAEQREDSSSPNNVDENKLETLTNVLYKIHKQTQDILTRCAVAYLIKNHNKISELEEDVQKLKKRRNEKKVEIKRLENQIQDNRLPSGRDKLLRI

SEQ ID NO: 588 - protein, 130 aa, Anabaena sp. AL09
MAEKNTPLINELLSQIGKHPEFETWRQKGKHPTGIVKELCEPLKIDPRFIGQPARFYTSATASVNYIYKSWFALMKRFQSQLDGKLRWLEMLNSDTELVEASGVSLDILQTKSAEILAQFAPQNPAKTQP

SEQ ID NO: 589 - protein, 128 aa, Anabaena sp. AL09
MSAPNQFGDSELGEYIDRLLAKEIIAVAQTYKAGSIVIPKLGDMREQIQSEIQSKAEQKSDIIEVQKKYAKQYRVSVHQWSYGRLIANVQSQANKAGIAIEEGKQPIRASPQEKAKELAINAYQSRKA

SEQ ID NO: 590 - protein, 157 aa, filamentous cyanobacterium CCP5
MAGVSFGLDKPATLAILDITTGQTIAYRSIRQLLGSDYKLLNRQRQRQHQKARQRHSEQLKFAPNRVSEGSIGDYIDSLITKAIIQIAQQYNASSIVLPDLANIREVIQSEIQARAEEKSSLKEVQDKYAREYLARVHRWSESEIPREFAKSLKQLR

SEQ ID NO: 591 - protein, 223 aa, Cyanothece sp. PCC 7822
MSSLSVIRARLLASEEKLSYLWQLMAQPYSQLIQLLLDYIANHPDFPTWLDKFRLPDTLIKEFITTHQTKYLCQELPGRFRQSAVTLVKNIYKSWFAHKKSKLLSLQGKKRFLSMLKSDEQLLLESGYDLYTLTSHAQNLLQQVQLELEELWQQEGIKPEDEQSIFGKITNKLYELHDKTQSIPKRCVIAYLIKNGNQIRGRTRRQRSLPTTSHPKRNPNSTP

SEQ ID NO: 592 - protein, 126 aa, Cyanobacterium sp. HL-69
MSHQNHKAKKRANFQQKGESNLGEYVDRLLAKSILKIAQEYKVSIIVVPRLKQMRSITEAEVQARAEEKIPEYKERQRKYAKDYRVQVHQWSYGRLIDNIKGNSSKLGIIVEEGTQPKQGRVLLEN

SEQ ID NO: 593 - protein, 133 aa, unicellular cyanobacterium SU2
MTHITVVQCRLIAPEGTLQHIWAMMAQQQTPLINERLHNINTHPDINTWLTANQLPSKLVETLAQPLKTQPPYQELPGRFITSAITLVKEMYASWFAVQTQKRLSLDGKKRFLSLLQSDEQLLQDSQTDFDTW

SEQ ID NO: 594 - protein, 189 aa, Lyngbya confervoides
METREMSQPNLPAYMKTIMCCLCASPETRRYFWETIVSYTLLVNELLEAVPNRPEFPQWQRRGTIDREAVRIVLKPLKTKPDYAGLPKRFLTSAELIVCYVYKSWLALQKRRQWQLEGKRRWLAAIEGDLKSILSSDLSLETVQATARQILEQAEQDLEPPPSEITKKGKKSKQHTAFLTLVRCSSSNL

SEQ ID NO: 595 - protein, 255 aa, Acaryochloris marina MBIC11017
MRSFEGKSLNTLKETQKTYLKRTQSSINRLQNASLRRPHVSPCIGNPELTMGVSLYCGLPLQASIVNNQTRKLVATITAPQLLKLEGYQDKLKPFKRSQFAYLIGRVHRQRVYWRKIKKKEFSKGRLRRSKRLENLGKKCDQLIAYHLIQWAQTHQVGDIVLPSPHGIQDHIEARVQSLAQLKFPNNKQLQKRYAKAIRLRYPRWSYTRLIQCIADCAERREMKVNILKFYKNAGPFEQSVEIAYAHLQYEAPSS

SEQ ID NO: 596 - protein, 583 aa, Leptolyngbya sp. NIES-3755
MSMKTIRSDAIVKLDPKPRGRKKNLEDLPPFDTAAWCRLCERTYHHTLLIDQISEQIKQDPDVINWIRATQDVKAQTSITTDTDQDTDTEQGHSWLPKELVQKLCDRLKETPQFKGISGRIFTSATERVEEIYKSWIATHQKLIRQIRGKERWLTIVKSDAGLAENSNFSQLEIESRAEQVLSEIEAENESEDESDDARNRRVFNTLFDKFDTTEDVLSRRAIIHLLKNGGKVHWEPRKPRRRKGNQDKSSQPMTLEERLAAKQIEIDRLEKQLLSQLPRARNLFPDWAFEEALDDLLTLPDPDLARHNQYYFLAFSLLIHQSDPAQNIRFKQHLLKSMSFLWEKPNSLLYYRILIFSFLLYTTSKQKHLQFGHYLLRAIKVEAERVESQFYDWQASITPKLSEFLREPKSLPYPISFGYEGVRAWQTNREGKIFFKLNGWGDLIFEVRCHRRQLPLIKTFLRDWQTKDQCEEEDQYSGSFMLLRSIELIWKPRDDNGQGDTQLCSQCEVFQQYPGKGFWNECKLSIHWTYDSDALTRQGLEKIRQRKLEPQLKKLDKKQEDLEEKQKLLQCLEAIPQILHHS

SEQ ID NO: 597 - protein, 581 aa, Leptolyngbya sp. NIES-3755
MKTIRSDAIVKLDPKPRGRKKNLEDLPPFDTAAWCRLCERTYHHTLLIDQISEQIKQDPDVINWIRATQDVKAQTSITTDTDQDTDTEQGHSWLPKELVQKLCDRLKETPQFKGISGRIFTSATERVEEIYKSWIATHQKLIRQIRGKERWLTIVKSDAGLAENSNFSQLEIESRAEQVLSEIEAENESEDESDDARNRRVFNTLFDKFDTTEDVLSRRAIIHLLKNGGKVHWEPRKPRRRKGNQDKSSQPMTLEERLAAKQIEIDRLEKQLLSQLPRARNLFPDWAFEEALDDLLTLPDPDLARHNQYYFLAFSLLIHQSDPAQNIRFKQHLLKSMSFLWEKPNSLLYYRILIFSFLLYTTSKQKHLQFGHYLLRAIKVEAERVESQFYDWQASITPKLSEFLREPKSLPYPISFGYEGVRAWQTNREGKIFFKLNGWGDLIFEVRCHRRQLPLIKTFLRDWQTKDQCEEEDQYSGSFMLLRSIELIWKPRDDNGQGDTQLCSQCEVFQQYPGKGFWNECKLSIHWTYDSDALTRQGLEKIRQRKLEPQLKKLDKKQEDLEEKQKLLQCLEAIPQILHHS

SEQ ID NO: 598 - protein, 99 aa, Tolypothrix campylonemoides VB511288
MSQITIQCRLVASVNTRQQLWKLMAEKNTPLINELLSQVAQHPEFETWRQKGKHPTGIVKELCQPLKTDPRFIGQPARFYTSAIALVNYNIESRKPIGF

SEQ ID NO: 599 - protein, 131 aa, filamentous cyanobacterium CCP5
PEDQKHDNYRQQDAESALGDYLDRLLAARVIQLAQKWQAGSIVLPSLGNIREIVESSVQAEAERRYPKHKELQDKYAKQYRLEFHRWSYGRLLKYLKECARQHGLTIRQERQPKQGSEQEKALALIASAFL

SEQ ID NO: 600 - protein, 141 aa, Geminocystis herdmanii
MSQKNTPLISELLLELSQHEDLEQWCELGKLPSGLISKLCDQLKQRAEFEGQPSRFYYSAITLVDYIYKSYLRTQRRLRFQLQGQQRWFEMFKSDTELKNETNFSLTDIRVKARELFDKDLKDSSPDDYFKTYESTSDLLT

SEQ ID NO: 601 - protein, 131 aa, Euhalothece sp. KZN 001
METWRQKGKLPAGIVSKLCKPLKEDSRFSGQPGRFYTSATKLVEYIYQSWLALQQRLQWRLNGQQHWLEILKSDQDLCQQADCSLETLCHQASEILASFQPSASNKKRNRKSKKIVLEKVCLMLMTMQKIV

SEQ ID NO: 602 - protein, 132 aa, Anabaenopsis circularis
MEASDNEEAKLSGSLVTLRSAHLLWQQGEGKGEPWKVNKLVLHCTYDARLLTAEGTEEVRQVKTDKAQNEVNEAESNENLDNEQQKRLNKNKSSLSRLKNSFARPSKPAYQGQSNIPLFCQFPDKMDRRKEK

SEQ ID NO: 603 - protein, 98 aa, Cyanobacterium sp. IPPAS B-1200
MSIPSGRDLEGKKWLETLILASTTMPINESESNSWFSALKKNSPSIPYPVIYETNEDLKWSLSDQNRLHVRFNGLSDHTFKIYCDSRQLPYFRRFYKA

SEQ ID NO: 604 - protein, 172 aa, Nodosilinea nodulosa
MSNMRTSECRLVSSYWERPSKAKPDSIALASDDTKAYLWSLSVGSTHLCQELNKRISNHELFEDWVQNAEIPDAEIKKIWKELKEGEMFKHIPERFCRSGLLTIQNIYSSWLSGRRKLQDRLKGLEYWLSIVKSDIELVSESGLDIEEIQVRAEEIINDLQAEAQASSDSQK

SEQ ID NO: 605 - protein, 106 aa, Stanieria sp. NIES-3757
MELAQQDRVSAIAVPKIEDIREITQAEIKAKAEAKIPGYEEGQKKYALAYRINIHNWSYGRLIENISTQANKLGIAIVEVKQPIRGSPTQKAQAMAISAHQAFNKT

SEQ ID NO: 606 - protein, 205 aa, Acaryochloris marina
MGVSLYCGLPLQASIVNNQTRKLVATITAPQLLKLEGYQDKLKPFKRSQFAYLIGRVHRQRVYWRKIKKKEFSKGRLRRSKRLENLGKKCDQLIAYHLIQWAQTHQVGDIVLPSPHGIQDHIEARVQSLAQLKFPNNKQLQKRYAKAIRLRYPRWSYTRLIQCIADCAERREMKVNILKFYKNAGPFEQSVEIAYAHLQYEAPSS

SEQ ID NO: 607 - protein, 83 aa, Merismopedia glauca
MSQITVQCRLVATEATRRCLWELMAIQNTPLINELLQQISLQDDFETWRSQAKLPSGTVERICQPLKSDPRFIGQPSRFYTSA

SEQ ID NO: 608 - protein, 86 aa, Tolypothrix sp. NIES-4075
MREQVQSEIQAKAEQKSDLIIVQKKYAKQYRVSVHQWSYGRLIANIQTQAAKVGIVIEESKQPITASPQEKAKELVIAAYHSRKIN

SEQ ID NO: 609 - protein, 110 aa, Anabaena sp. WA102
MSRNNKKNSTNPIIRTIRCHLNAKEDVLRQVWEEMTQKNTPLIVQLLEDVSEQPEFDTKKETGEISKKEITELRKSLTKDSDLEKQSGRFRSSADSFVQEVYSALASLLW

SEQ ID NO: 610 - protein, 88 aa, filamentous cyanobacterium CCP2
MREHLAAEINAKAERKSDSKEVQDKYAKQVRISIHRWSYDRLLSTISSQANKLGLTLETMAQPPHGTPQEKARDVAIAAYHSRQVSSN

SEQ ID NO: 611 - protein, 61 aa, Anabaena sp. AL93
MSQITIQCRLVASETTRQQLWQLMAEKNTPLINELLSQIGKHPEFETWRQKGKQPTYNEKG

SEQ ID NO: 612 - protein, 107 aa, Phormidesmis priestleyi
MLLRKEYIFEVCCDRRQLQTFQVFLNDWQTYSSDKNKYPITLFAFRSAALIWRQSTENGISKLQPYLKCTVDHKRLSAKGAEPRAEEIAKVRKNSQIIRRNSKVEKS

SEQ ID NO: 613 - protein, 50 aa, Cyanothece sp. ATCC 51142
MSQITIQCRLVAKEPIRHTLWRLMTDLNTPFINELLQKVAQHPDFEKWKQ

SEQ ID NO: 614 - protein, 76 aa, Anabaena sp. AL93
MTQKNTPLIVQLLEDVSEQPEFDTKKETGEISKKEITELRKSLTKDSDLEKQSGRFRSSADSFVQEVYSALASLLW

SEQ ID NO: 615 - protein, 78 aa, Stanieria sp. NIES-3757
MRVAMGLDKPATVAIVDGNTGKVIVYRSIKQLLGENYRLLNRQRQQKQALSLFCHFPKTFVISKVYNPYQQNDSLVIY

SEQ ID NO: 616 - protein, 74 aa, Stanieria sp. NIES-3757
MGLDKPATVAIVDGNTGKVIVYRSIKQLLGENYRLLNRQRQQKQALSLFCHFPKTFVISKVYNPYQQNDSLVIY

SEQ ID NO: 617 - protein, 72 aa, Phormidesmis priestleyi
MSELLLFDTYEVTEDSLSRRAVIHLLKNGGEVNEEIEDPEKLQQRLVTKREEIQRLEAQLASRLPKGREPNR

SEQ ID NO: 618 - protein, 74 aa, Aphanothece hegewaldii
MSDQQSQNHEITIQSLLKAPEATLRILWQLMVNVTELINSILHHINTHPDFDTWLTEWELPASILNSFIRNAKT

SEQ ID NO: 619 - protein, 148 aa, Trichormus azollae
MTYEFVFLPVGNADSIIMHPDGSSTVVIDLHKIPLLLNWFENKKQTNISRILFIRHEHRYYFPSLEDLVTFLENRRRRGIVTEISPPYHVLRNAKAGSIMLPKLGDMRENIQSKIQTIAEAKYPGSVEIQRKYAKQYEMSINGVMADL

SEQ ID NO: 620 - protein, 61 aa, Nostoc flagelliforme
MSNYQIHYWSYNRLQKYIKSKAAELKISIEFGIQPHYGTLEEQARDLAFCAYQCRINTFGR

SEQ ID NO: 621 - protein, 379 aa, Archaeoglobus profundus
MELTLKMKVREKTKWKIQALRDAMDSFRQAVNDWIDVAWKHKITDRTLHSLAYKKLREKYPNLYSNSLQDAMNWAIQIVKTELKVNPDVKPKFDSFMISFKNVDFKFENDGFVIPLNGKRVYVPVYVPKKYYKWLVNGKFGRLYFKEEDGEIYAYLTVKVEDKPAYEPKLWFGVDLGVQNLVVVADNKGREVLRFDGETVNHYKELLEKERARRQRRQMKYLNNRKFRLGSKHRNFSKYINHIIAKEIVRKAKEYQACIVLEKLRGVKRRSAKMPKWVRKLLHRWSYHDLIQKIKYKAKLEGVPVIEVSPRNTSKTCSECGYVYKRFKNQRLFHCPNCGLIIDRDLNASTNIARKGMKEFNKRAFLPALKGEASSPQRR

SEQ ID NO: 622 - protein, 72 aa, filamentous cyanobacterium CCP2
MRDRSFAQHGGQVGEQEEDPEAFAQMIHRKQKEIERLEAQLVSRLPKGRDLTGEEFLETLATATTTQCVEAA

SEQ ID NO: 623 - protein, 82 aa, Phormidesmis priestleyi
MDTLSQESIPPWKTHRLYLQCSIDSDLLTAEGTEKVRPRKISETRKTLDNARKKEQELLVQTFRSDLTEQDKQELEKGATSI

SEQ ID NO: 624 - protein, 379 aa, Archaeoglobus profundus
MKLTLKMKVREKTKWKIQALRRAMETFRDAVNDWIDVAWKHKIADRTLHEIAYKELRQKYRNLYSNSLQDAMNWAIQIVKTELKLNPNKKPEFKTLMISFKNVDFKFENNGFVIPLNGKRVYVPVYVPKKYYKWLVNGKFGRLYFKEEDGEIYAYLTVKVEDKPVYEPKSWFGVDLGVHNLAVVADERGRKILRFDGEIVNRYKELLEKERARRQKRQMKEFNNKEHKYGCKHRSFSRYVNHVVSKEIVRKAKEYKACIVLEKLRGVKRRGARKPKRVRKLLHRWSYHDLIQKIKYKAKLEGVPVIEISPRNTSKTCSNCGFVYKRFKDQRLFHCPKCGIIIDRDLNASINIARKGREEYKKRAFLSALKSEASSPQWL

SEQ ID NO: 625 - protein, 45 aa, Richelia intracellularis
MSENIQSQAVKTGILIEVGQQPIRGSPQKQARELGLFAYQYRMAT

SEQ ID NO: 626 - protein, 226 aa, Hydrogenivirga sp. 128-5-R1-1
MGTAEFFVGVDLGLRKLAVVSTSDGRINKFFDGGYVRAVSEKYQALRKRLQSKGTPSAKRHLKKLSQREKRFRTAINHKVAKEVVELVPAGGVIVLEKLKGIRKRVKVGKQNRRWIHSWNFAQLQRFIEYKAKAKGIKVVYVDARYTSQKCSKCGHISKKNRKGQAHFVCERSGYQLNADLNAGRNIVKNYLASLEGKSGHGEASPSVWDAVNRADVGSVGCAMHG

SEQ ID NO: 627 - protein, 84 aa, Anabaena sp. WA102
MAQFAPQNPAETQPAKSKKGKKSPTSDSERNLSKNLFDTYSNTEDNLTRCAISYLLKNGCKISNKDFNTFQHPSRSGLRCTHKS

SEQ ID NO: 628 - protein, 406 aa, Streptomyces sp. MP131-18
MFCVKIVAQVKLLPASAHDADALAATLRACNRAANTASEVAFTKDLKRRNTLQDAVYHRIKADFDLGAQAAVRTIKKVCDAYAALKGNIKAGNLGPKGSKRRTRAESRPVGFRDDAAQPFDDRILTWNLDQRTVSVWTVAGRLKGIPFVCSPEAMTLLASRKGESDLVMRDGTFFLIATIDVPEPLVSEPDGSLGVDLGIVNIATTSDGQIMAGRRLNRYRKRHRDLRRKLQKKRTKAAKRALKRMRRREARHAAHTNHIIAKRIVATAERTSRGIALEDLGGIRQRVTARKDQRARLHSWAFAQLGTFVEYKARRAGVAVVHVGPRNTSRQCSECRHTHRTNRVDQARFVCRSCGIVLHADHNGSRNIAHRGEAVWQRGAVKRPSTAQRYTGRRGPTRQPVALHL

SEQ ID NO: 629 - protein, 403 aa, Streptomyces sp. MP131-18
MKIVAQVKLLPASAHDADALAATLRACNRAANTASEVAFTKDLKRRNTLQDAVYHRIKADFDLGAQAAVRTIKKVCDAYAALKGNIKAGNLGPKGSKRRTRAESRPVGFRDDAAQPFDDRILTWNLDQRTVSVWTVAGRLKGIPFVCSPEAMTLLASRKGESDLVMRDGTFFLIATIDVPEPLVSEPDGSLGVDLGIVNIATTSDGQIMAGRRLNRYRKRHRDLRRKLQKKRTKAAKRALKRMRRREARHAAHTNHIIAKRIVATAERTSRGIALEDLGGIRQRVTARKDQRARLHSWAFAQLGTFVEYKARRAGVAVVHVGPRNTSRQCSECRHTHRTNRVDQARFVCRSCGIVLHADHNGSRNIAHRGEAVWQRGAVKRPSTAQRYTGRRGPTRQPVALHL

SEQ ID NO: 630 - protein, 374 aa, Mariprofundus ferrinatatus
MMRTASIKLDVTAEQSASLRDLQSAYVDACNKLVPVASDHRCWNRVALHALAYTLLRSTTPLGSQMVCNAIYSVCKAYKAQKELGRIRKDKPVPIIGFKKSSIHFDKRTYTIKGDMVSLYTLGGRISVPMIMGQHQHEMLRSGMPKEAELICRKGKWYFNLVVEKEDTEKLTSGPVVGVDVGENNLAATSIGKVYGGGDLRHRRDKHLALRRRLQSNGSRSAKQKLRQVSGKEQRRVKHINHETSKSIVQEAQKTGASKITMEDLNHIRDNIKAGKRVRTRLHRWAFRQLQTFIQYKAEAVGITVEFVNPAYTSQTCSACGSLGNRDRHRFECLCGLRAHADLNASRNLARIGSGIPLSKAFVNTPDVPSGIDA

SEQ ID NO: 631 - protein, 288 aa, Thermococcus sp. 2319x1
MLDDHLFKLDLEAGVIKLSAPGGRIPLKFYPAKYHEKFKSWRVGQAWLVKTPKGVFINVVFSKEVEVGEPETFVGVDLNENNVTLSLPNGGFVQIITHEREIRTGYFVKRRRIQKKMRAGRKRKELLEKYGERERNRLNDLYHKLANKIVELAEKYGGIALEDLTEIRDSIRYSAEMNGRLHRWSFRKLQSIIEYKAKLRGIKVVFVNPAFTSSLCPICGEKLSPNGCRVLKCKCGFEADRDVVGSWNIRLKALKMWGVSVPPESQPMKLGGWKPARYEINTLHTLYG

SEQ ID NO: 632 - protein, 349 aa, Vulcanibacillus modesticaldus
MEQTVKIKLLPTKEQEYHLINISREYIKTVNTLVADMVQAEKILKLSSKDVHVSMPSAVKNQAIRDAKSVYRKVKKLKRVPILKKSVCIWNNQNYKIKESVIEFPVYINGKSKRIAVKAILTEYQHNLLKNQLGILRITKKSNKWIAQIAVKIPGPTQNNSDIVMGVDLGLKVPAVAVTSTGKTRFFGNGRQNKYIRRKFKSQRRELGKSKKLNAIRKLNDKETLWMKDKDHKISRTLVDFAIKNNVSVIRLEKLSNIRNTARTSRKNEKNLHTWSFYRLAQYIEYKAKLAGIKVEYVDPKYTSQICPMCGKRNHTKDRKYQCSCGFKTHRDRVAGINIINAPVIDGVA

SEQ ID NO: 633 - protein, 394 aa, Thermococcus paralvinellae
MISYVYDRNITSFYRLKNAKYKELRNRYLYLPSHYIYTACQMATSIFKSYRKKRRKGKAKGKPVFKKDVIMLDDHLFKLDLENGIIRLSTPNGRISLEFYPAKYHEKFKDWRVGQAWLVRTPKGVFINIVFSKEIEIGEPKSFIGIDLNENNVTLSIPNGEFVQIITHEREIRTGYFVKRRKIQKKIRTGKRRKALLQKYGEREKNRLNDLYHKIANVIVEFAKRYGGITLEDLTEIRESIMYSAKMNGRLHRWSFRKLQSIIEYKAKLNGIKVVFVNPSYTSSRCPICGNKLSPKGHRILECSNCGLKTNRDVIGSWNIRLKALKMWGVSVPPESQPMKTGGWKGKFQNGIEFSTIKAEYFFDNPPIWHSQKFSVHALFDVQTTIRRSEYGRF

SEQ ID NO: 634 - protein, 393 aa, Pyrococcus sp. ST04
MPSETIKLTAKFKLKNPPRELDDLFSTYHKIVNYLITYAFENNVTSFYRLKKETYKNLRKEYSSLPSHYLYTACQMATSIYKSYRKRKRKGKARGKPVFKKEVIMLDDHLFKLDLEKRVIKLSTPSGRIILEFYPAKYHEKFKGWRIGQAWLIKTPKGVFVNVVFSKEVEVGEPKAFVGVDLNENNVTLSLPNGEFVQIITHEREIRTAYYLKRRRVQRKIRAGRRREELLEKYGERERNRVNDLHHKLANKIVELAEKYGGIALEDLTEIRESIRYSAEMNGRLHRWSFRKLQSMIEYKAKLRGVKVVFVNPAYTSSLCPVCGGKLSPNGHRVLKCSNCGFEADRDVVGSWNIRLKALKMWGVTVPPESHPMKMGGWKPTRYEINAPHTTNG

SEQ ID NO: 635 - protein, 388 aa, Thermococcus celer
MPSETIKLAAKFKLKNPPNGLDGLFQTYREIVNTLITHAHENNITSFYRLKKETYKKLRKEYSELPSHYLYTACQMATAIYKSYRKRKKKEKAKGKPAFKKEVIMLDDHLFKLDLKGEVKLSTPGGRVSLEFYPARYHEKFRGWKVGQAWLVKTSKGVFVNVVFSKEVEVGEAKSFVGVDLNENNVTLSLPDGEFVQVITHEREIRTGYYVKRRKIQKKLKAGKRREKLLEKYGGREKNRLNDLYHKIANKIVELAEEYGGIALEDLTNIRESIRYSAEMNGRLHRWSFRKLQSIIEYKAKLRGVSVVFVDPAYTSSRCPVCGGKLSPNGYRGVKCECGFEADRDVVGSWNIRLRALKMWGVSVPPESHPMKMGGWKVGRNDVYKSYG

SEQ ID NO: 636 - protein, 380 aa, Chloracidobacterium thermophilum
MLRTASIRLNVGPDQAAALAALQAAYADACNRLVPTVVEHRCWNRVALHHLAYARLRKETPLGAQMVCNAIFSVCKAYKAQKELGRIRKDAPVPAVHFNRASVHFDKRTYAIKGECLSLYTLSGRIAVPMVLGEHQRRILASGKAKEAELVCRKGRWYFNLVVESEDSDPIASGRVMGVDVGENHLAATSTGKVWGGGQLRHKRNGYLALRRRLQSNGSQSAKQKLRQVSGKERRRITHINHETSKAIVAEALRFGASKIVMEDLTHIRDRIQAGKRMRARLHGWAFRQLQSFVEYKAKAAGIAVEYVDPAYTSQTCSCCGALGRRIKHRFVCNKCGLRAHADGNASRNLARIGSGAPLPRAAVNTPDVGDVSHNCCVSQ

SEQ ID NO: 637 - protein, 396 aa, Thermococcus celer
MPNETIKLTAKFKLKEIPDGLDGLFQTYREIVNTLITHAHENNITSFYRLKKETYKSLRKEYPELPSHYLYTACQMAAWIYKSYRKRKKKGKAKGRPVFRKEVIMLDDHLFKLDLDGKIIKLSTPNGRISLEFYPARYHEKFRGWKVGQAWLVKTPKGVFVNVVFSTEVEVGEAKTFVGVDLNENNVTLSLPDGEFVQIITHEREIRTGYFLKRRRIQKKFRAGKKREKLLEKYGGREKNRLNDLYHKIANKIVELAEEYGGIALEDLTNIRDSIRYSAEMNGRLHRWSFRKLQSIIEYKAKLRGVSVVFVDPAYTSSRCPVCGGKLSPNGYRRVKCECGFEADRDVVGSWNIRLRALKMWGVPVPPESHPMKMGGWKVSRNDVYKSYGQPERVPY

SEQ ID NO: 638 - protein, 389 aa, Thermococcus celer
MPNETIKLTAKFKLKEIPDGLDGLFQTYREIVNTLITHAHENNITSFYRLKKETYKSLRKEYPELPSHYLYTACQMATAIYKSYRKRNKKGKAKGRPVFRKEVIMLDDHLFKLDLDGKIIKLSTPNGRISLEFYPARYHEKFRGWKVGQAWLVKTPKGVFVNVVFSTEVEVGEAKTFVGVDLNENNVTLSLPDGEFVQIITHEREIRTGYFLKRRRIQKKFRAGKKREKLLEKYGGREKNRLNDLYHKIANKIVELAEEYGGIALEDLTNIRDSIRYSAEMNGRLHRWSFRKLQSIIEYKAKLRGVSVVFVDPAYTSSRCPVCGGKLSPNGYRRVKCECGFEADRDVVGSWNIRLRALKMWGVPVPPESHPMKMGGWKVGRNDVYKSYG

SEQ ID NO: 639 - protein, 419 aa, Thermococcus nautili
MRTSVAVNRIWVGQRPIHPTDIPLGIINTNYMQTLINFVVVVIIMCGIKLTQTFKLMKPNKRKRELLDATIERFKECVNAWISEIEQLGEYPTRKNVHSFAYKKIREQFKDLHSNVVQEAMNRAIEVYRAWLKTKGQKPVFTADVVSFKNVDVKIDRHFINVPLINKERVWLPMHVPKKLRKFLKMKHGRVQISKVDDEYYAQISFEVPEPKPYEPKGWLGVDIGINHIVVISDDKGKINKFYDNAIAWKKSVEYRRARLQFLKDKRTKKGAWRILKRLSHKEKNKMAYINHKIAKEIVELAKHYHYGIAIENLKGIRHHYNAKRHRKRLHKWAYGDLIDKIVYKAKLNGVPVVFVDPRNTSRTCSKCGYLVEKGVKGRWFRCPKCGFQLDRDLNAARNIAKRAFRLAPWGASSSQRRW

SEQ ID NO: 640 - protein, 393 aa, Thermococcus celericrescens
MPSETIKLTAKFKLKNPPEELNDLFSTYREIVNYLISYAFENNITSFYRLKKETYKSLRKEYPKLPSHYHYTATQMATMIYRSFRKRKKKGKASGRPVFKKEVIMLDDHIFKLDLGAGIIKLSTPSGRIVLEFYPAKYHEKFKEWKVGQAWLVRTPKGVLINVVFSREVDVGEPKTFVGVDLNENNVTLSLPNGEFVQIITHERELRTGYFLKRRKIQRKLRTGKRRKELLEKYGQRERNRLNDLYHKLANKIVELAEKYGGIALEDLTEIRDSIRYSAEMNGRLHRWSFRKLQSIIEYKAKLKGIKVVFVNPAFTSSLCPVCGEKLSPKGHRVLKCPNCGFEADRDVIGSWNISLRALKMWGVSVPPESPTMKAGVGKVSRNDAYELYKSYG

SEQ ID NO: 641 - protein, 393 aa, Thermococcus sp. 4557
MPNETIKLTAKFKLKGTPDGLDDLFSTYREIVNFLITYAFENNITSFYRLKKETYKSLRKEYPELPSHYLYTACQMATAIFKSFRKRKKKGKTRGRPVFKKEVIMLDDHLFKLDLENKIIKLSTPNGRIQLEFYPAKYHEKFKDWKVGQAWLVRTPKGIFLNVVFSREVEISEPNAFVGVDLNENNVTLSLPNGEFLQIITHEREIRTGYFVKRRKIQQKIQAGKKRKELLEKYGEREKNRLNDLYHKLANKIVEVAEKYGGIALEDLTEIRESIRYSAEMNGRLHRWSFRKLQSIIEYKAKLKGVKVVFVNPAFTSSLCPICGEKLSPNGHRVLKCSNCGFEANRDVVGSWNVRLRALKMWGVTVPPESPTMKTGVGKVSRNDVYELYTSYG

SEQ ID NO: 642 - protein, 375 aa, Thermococcus nautili
MCGIKLTQTFKLMKPNKRKRELLDATIERFKECVNAWISEIEQLGEYPTRKNVHSFAYKKIREQFKDLHSNVVQEAMNRAIEVYRAWLKTKGQKPVFTADVVSFKNVDVKIDRHFINVPLINKERVWLPMHVPKKLRKFLKMKHGRVQISKVDDEYYAQISFEVPEPKPYEPKGWLGVDIGINHIVVISDDKGKINKFYDNAIAWKKSVEYRRARLQFLKDKRTKKGAWRILKRLSHKEKNKMAYINHKIAKEIVELAKHYHYGIAIENLKGIRHHYNAKRHRKRLHKWAYGDLIDKIVYKAKLNGVPVVFVDPRNTSRTCSKCGYLVEKGVKGRWFRCPKCGFQLDRDLNAARNIAKRAFRLAPWGASSSQRRW

SEQ ID NO: 643 - protein, 213 aa, Candidatus Wildermuthbacteria bacterium RIFCSPLOWO2_02_FULL_47_9c
MFQTAEIPEENIKDVEEFLGVDFGLRHIATLSTGEKMSGKDLENYRIKRQRVRSSLQSKCTTNARKVLKRLSGKERTTARIVNHTIAKTIVEKAKAENKGIALENLKGIRERSLKKGRVFRSRVGRWNFSFLRQAIEYKARLAGIPVVLVNPRHTSQRCFRCGNLGSRKGESFKCACGFIEHADVNAARNIAFLALPVNQGEKSAMCPVLSHG

SEQ ID NO: 644 - protein, 389 aa, Streptomyces glauciniger
MVTSVKIVTQVKLLPEAGQAAALRSTLRTVNELANWVADVAFAHDVPREYELRKHTYAHLKAQGLGAQAAQHVIKKVRDAYTTLHANLLGGNLGKPGSKRRIKAESKPIAFRPQAAQPYDDRCLSWQYDQQTVSIWTTAGRIKNVRFACSAGALKTLQQYRKGESDLIERDGIFYLVAVCEVPEAVPYEPDGIIGVDLGIVNIATTSTGYQAAGRRLNRYRKRQLALRSKLQKKRTRSAERRLKERRSREARHVKNTNHVIAKTIVTEAERTSAGIALEELKGIRQRVRLRKPQRVTLHSWAFAQLADFIVYKARRAGVPLVYVDPAYTSQMCCECGHTDKRNRVDQGLFICRNRGVVAHADRNASHNIAARGAVVWTAGRESRVPATP

SEQ ID NO: 645 - protein, 377 aa, Lachnospira multipara
MQLSETLKLYMTNEQKALVVMTMNEYISTVNSLVSVAISGISISKYTTADVKANLPSALTNQCIRDAKSIVKKHNKACRDADRKNAKFANQGKDIKIVATVPTLKKPCCYINNQNFKINGDYIEFPVMVKGKSKRLSVKTKMTDNQKSVFANSKLGTMRIVYKGNKIVAQVVYETVEPTYDSEGNVMGVDLGIKCPAVSYTSDGNIKFYGNGRKNKYMRRHYKYLRKKLQKAKHINAVKRINDKEQRIMRDIDHKISHDIVKTAVTHNVKTIKLERLANIRSTTRTSRKNNHSLHNWSFYRLAQFIEYKAKLAGIAVEYVNPAYTSQTCPVCGHVHHANDRIYACKCGFHIHRDILGAMNICNSTEYVGDNDIRHTA

SEQ ID NO: 646 - protein, 351 aa, Streptomyces griseoluteus
MAFAKGLKRRNVLQKEVCFALKANYDLGAQPAVRVVKKVCDAYATLKANIRAGNLGREGSKSRLRAESKPIVFRGDAAQPFDDRILTWNLDARTVSIWTVAGRIKYIPFVCSDQAFDLLASRKGESDLVMRDGVFFLIATLDIPEPEVSEPDGFLGVDLGIVNIATTSDGEIMAGRGLNRYRQRHRDLRQKLQKKRTKSAKRVLKRVRRREARHAANTNHIIAKQLVATAERTSRGIALEDLSGIRQRVTAKKDQRARLHSWAFAQLGGFVEYKARRAGVPVVFVDPRNTSRQCSECRHTHRTNRVTQARFVCRSCGTVKHADHNGSRNIAHRADAVWKRGAVNRPGSGAS

SEQ ID NO: 647 - protein, 397 aa, Desulfurobacterium thermolithotrophum
MNMKLQRTLKLVLKPTEEQKQTLLETIEQYKFAYNYTCKVGWSAKTWNGIELHKLTYYTVREKTSLPSQLVISARVVATESLKSAIKRKKKGLKSKCPQSNNPAIRYDRRSYTVWLEREEVSLATVKGRQKFKVKVPDYFKQYLDWRVTSANLKYDKRLKKFFLNITCEKEFPDVEPVNYFVGVDLGLRNLAVVSTPDGKINKFFDGGHIRAVSERYFALRKRLQSKGTPSAKRHLKTLSQKEKRFRTAINHRIAKEIVSLVPAGGVIVLEKLKGIRKRIKVNKQNRRWIHSWNFAQLQQFIEYKAQAKGIRVVYVDARYTSQKCSRCGHISRSNRIDQSHFVCKHCSYSLNADLNASRNIVKNYLASLQRGEVGTGSGISLPVGRCQPSQCSGATC

SEQ ID NO: 648 - protein, 393 aa, Desulfurobacterium thermolithotrophum
MNMKLQRTLKLVLKPTEEQKQTLLETIEQYKFAYNYTCKVGWSAKTWNGIELHKLTYYTVREKTSLPSQLVISARVVATESLKSAIKRKKKGLKSKCPQSNNPAIRYDRRSYTVWLEREEVSLATVKGRQKFKVKVPDYFKQYLDWRVTSANLKYDKRLKKFFLNITCEKEFPDVEPVNYFVGVDLGLRNLAVVSTPDGKINKFFDGGHIRAVSERYFALRKRLQSKGTPSAKRHLKTLSQKEKRFRTAINHRIAKEIVSLVPAGGVIVLEKLKGIRKRIKVNKQNRRWIHSWNFAQLQQFIEYKAQAKGIRVVYVDARYTSQKCSRCGHVSRSNRIDQSHFVCKHCSYSLNASRNIVKNYLASLQRGEVGTGSGISLPVGRCQPSQCSGATC

SEQ ID NO: 649 - protein, 397 aa, Desulfurobacterium thermolithotrophum
MNMKLQRTLKLVLKPTEEQKQTLLETIEQYKFAYNYTCKVGWSTKTWNGIELHKLTYYTVREKTSLPSQLVISARVVATESLKSAIKRKKKGLKSKCPQSNNPAIRYDRRSYTVWLEREEASLATVKGRQKFKVKVPDYFKQYLDWRVTSANLKYDKRLKKFFLNITCEKEFPDVEPVNYFVGVDLGLRNLAVVSTPDGKINKFFDGGHIRAVSERYFALRKRLQSKGTPSAKRHLKTLSQKEKRFRTAINHRIAKEIVSLVPAGGVIVLEKLKGIRKRIKVNKQNRRWIHSWNFAQLQQFIEYKAQAKGIRVVYVDARYTSQKCSRCGHISRSNRIDQSHFVCKHCSYSLNADLNASRNIVKNYLASLQRGEVGTGSGISLPVGRCQPSQCSGATC

SEQ ID NO: 650 - protein, 397 aa, Desulfurobacterium thermolithotrophum
MNMKLQRTLKLVLKPTEEQKQTLLETIEQYKFAYNYTCKVGWSAKTWNGIELHKLTYYTVREKTSLPSQLVISARVVATESLKSAIKRKKKGLKSKCPQSNNPAIRYDRRSYTVWLEREEVSLATVKGRQKFKVKVPDYFKQYLDWRVTSANLKYDKRLKKFFLNITCEKEFPDVEPVNYFVGVDLGLRNLAVVSTPDGKINKFFDGGHIRAVSERYFALRKRLQSKGTPSAKRHLKTLSQKEKRFRTAINHRIAKEIVSLVPAGGVIVLEKLKGIRKRIKVNKQNRRWIHSWNFAQLQQFIEYKAQAKGIRVVYVDARYTSQKCSRCGHISRSNRIDQSHFVCKHCSYSLNADLNASRNIVKNYLASLQRGEVGTGSGISLPVGRCQPSQCSGATW

SEQ ID NO: 651 - protein, 392 aa, Thermococcus sp. 40_45
MSSETIKLTAKFKLKEIPEGLDDLFSTYREIVNYLITYAYEANITSFKRLKKETYKELREKYPQLSSHYLYTACQMATSIYKSYRKRKRKGKAKGKPVFKKEVIMLDDHLFKPDLEKGVIKLSTPKGRIQLEFYPAKYHEKFKDWKVGQAWLIKTPKGAFINAVFSKEVEVRESKAFVGVDLNENNVTLALPNGEFVQIITHEREIRTGYFVKRRKIQKKLKTGKRRRELLEKYGEKERNRLNDLYHKLANKIVELAVKYGGIALEDLTEIRDSIRYSAEMNGRLHRWSFRKLQSIIEYKAKLKGIKVVFVNPAFTSSLCPICGGKLSPNGHRVLKCRCGFEADRDVVGSWNIRLKALKMWGVSVPPESHPMKMGGWKVSRNDIYELYKSYG

SEQ ID NO: 652 - protein, 349 aa, Streptomyces scabiei
MAFARDLKRRNGLQDAVYHRIKADFDLGAQAAVRTVKKVCDAYATLKANLRAGNYGPEGSKRRAKVEAKPIRFREGAAQPYDDRILTWNLDARTVSVWTVAGRIKGIPFVCAPGAMRLLASRKGESDLVMRDGMFFLVATIDAAEPEAYEPDGFLGVDLGIVNIATTSDGEIMAGRQVNRYRQRKRDLRTRLQKKRTKSTARVLKRQRRKESRYATQRNHIIAKKLVATAERTSRGIGLEDLSGIRQRVTARKDQRARLHSWAFAQLGAFVEYKAKRAGVPVVHVDPRNTSRQCSECWHTHRTNRTGQARFACRSCGIVLHADHNGSRNIAHRADAAWKRGAVNRPSTA

SEQ ID NO: 653 - protein, 389 aa, Candidatus Korarchaeum cryptofilum
MPLETVKLTASFKLDGSFPESLFSTYREVLGQLLDYAWEKGVTSFKRLKAEKYCELRARYPSLPSHYIYTACQMACSIYKSFRKLKRRGATKAEKPVFKKEVIMLDDHLFSLDLEGWEASIAVGGSRVRLKLLHGTYHEKFKGMRVGQAWLVKRGNDLYLKAVFSKVVEVAEMDERAVAVDVNENNVTFGTMERVVNVETRERIIRTAYFLKRRRLQSKPRLNEKPLLAKYRGRERRRVEAIYHEVANRIIDEAKKVKASTIVLEDLTNIRERIKRSKELNGRLNRWSFRKLQRIVEYKAKLAGLNVVYVEARGTSSLCPICGERLSPNGHRRLKCRCGLEEDRDVVAVKNLLRKYRMDVGASSVHPEGPPMTTERDEEYEGGRDESLF

SEQ ID NO: 654 - protein, 377 aa, Sharpea azabuensis
MQLSETVKLYMTGEQKSLIVATMTEYINTVNSLVSDAANGISISKYTTADVKANLPSALTNQCIRDAKSIVKKYNKACRDADRKNNKLAKQGKNITVTATLPVLKKTCCYVNNQNFKINGDYIEFPVMVNGKSKRLSVKTKMSDKQKSVFANSKLGTMRIVYKGSKIVAQVVYETIEPTYTTEGNVMGVDLGVKCPAVSYISDGSVKFYGNGRKNKYMRRHYRCLRKKLQKAKHIDAVKRINDKEQRIMKDIDHKLSHDVVETAVAHNVKTIKLERLANIRSTTRTSRKNNHSLHNWSFYRLAQFIEYKAKLAGIAVEHVNPAYTSQTCPVCGHVHHANDRNYTCKCGFHIHRDILGAMNICNSTEYVGDSNIRHTA

SEQ ID NO: 655 - protein, 368 aa, Dethiobacter alkaliphilus AHT 1
MITMQITVKIKLQPTKKQADLISATKNEYIRLVNQIVSEYVEADENLKYSSKDVKAFLPSALKNQAIQDARSIFVKYKKQRIANDRLEPENQREIKVPILKKPVSIWNNQNYSLQSNILSFPVWLDGKSKRIAVNAVLTEYQLNKLTGKLGSLRITEKSGKYIAQIAVDAVEEHTDADKTMGVDVGLKIPAVAVVEGGKTKFFGNGRQNKFIKRKHRSTRRKLGQLKKLSAIRKRHDKEQRWMKDQDHKVSRQIINFAKEHNVGTIHLEKLSGIRQTARTSRKNEKNLHNWSFYRLAQYIEYKATLAGMKVKFVDPKHTSQKCPQCCALNKAKDRNYQCGCGFIAHRDRVGAINIISATVADGHSLPA

SEQ ID NO: 656 - protein, 365 aa, Dethiobacter alkaliphilus
MQITVKIKLQPTKKQADLISATKNEYIRLVNQIVSEYVEADENLKYSSKDVKAFLPSALKNQAIQDARSIFVKYKKQRIANDRLEPENQREIKVPILKKPVSIWNNQNYSLQSNILSFPVWLDGKSKRIAVNAVLTEYQLNKLTGKLGSLRITEKSGKYIAQIAVDAVEEHTDADKTMGVDVGLKIPAVAVVEGGKTKFFGNGRQNKFIKRKHRSTRRKLGQLKKLSAIRKRHDKEQRWMKDQDHKVSRQIINFAKEHNVGTIHLEKLSGIRQTARTSRKNEKNLHNWSFYRLAQYIEYKATLAGMKVKFVDPKHTSQKCPQCCALNKAKDRNYQCGCGFIAHRDRVGAINIISATVADGHSLPA

SEQ ID NO: 657 - protein, 390 aa, Thermovibrio ammonificans
MNMKLQRTLKLVLKPTEEQKQILLETLEQYKFAYNYTCRIGWEAETWNGVQLHKLTYYTVRNKTSLPSQLVISARVVATESLKSAIKRKKKGLKSRCPESKNPVIRYDKRSYTVWLNREEVSLATVGGRQKFKVKIPDYFKQYLDWKVTSTNLKYDKKLKKFFLNITVEKDFPDVEPVDFCVGVDLGLRKLAVVSTPDGKINRFFNGGHIRTVSERYFALRKRLQSKGTPSAKRHLKKLSQKEKRFRTAVNHKIAKEIVALVPAGGVIVLEKLKGIRQRIKVNKQNRRWIHSWNFAQLQQFIEYKAQAKGIRVVYVDARYTSQKCSRCGYISRSNRIDQSHFVCKHCGFSLNADLNASRNIVKNYLTSLHRGEVRTGAGISAPVGRCQPS

SEQ ID NO: 658 - protein, 388 aa, Thermovibrio ammonificans HB-1
MKLQRTLKLVLKPTEEQKQILLETLEQYKFAYNYTCRIGWEAETWNGVQLHKLTYYTVRNKTSLPSQLVISARVVATESLKSAIKRKKKGLKSRCPESKNPVIRYDKRSYTVWLNREEVSLATVGGRQKFKVKIPDYFKQYLDWKVTSTNLKYDKKLKKFFLNITVEKDFPDVEPVDFCVGVDLGLRKLAVVSTPDGKINRFFNGGHIRTVSERYFALRKRLQSKGTPSAKRHLKKLSQKEKRFRTAVNHKIAKEIVALVPAGGVIVLEKLKGIRQRIKVNKQNRRWIHSWNFAQLQQFIEYKAQAKGIRVVYVDARYTSQKCSRCGYISRSNRIDQSHFVCKHCGFSLNADLNASRNIVKNYLTSLHRGEVRTGAGISAPVGRCQPS

SEQ ID NO: 659 - protein, 393 aa, Thermococcus sibiricus
MPSETIKLTAKFKLKETPDGLDELFSTYRDIVNSLITYAFENNITSFKRLKKEKYEELRKDYPELPSHYHYTACQMASSIYKNYRKRKRRGKANGRPVFKKDSIMLDDHLFKLDLEKGIIKLSTPKGRITLEFYPAKHHGKFRGWKVGQAWLVRTPKGVFINVVFSKEVEVKEPEDFVGVDLNENNITLSLSDGEFVQIITHEREIRTGYFVKRRKIQKKVKVGKKRQRLLEKYGERERNRLDDLYYKLANKIVELAEKYGGIALEDLTGIRESIRYSAEMNGRLHRWSFHKLQSIIEYKAKLKGVKVVFVDPAYTSSLCPICGGKLSPNGHRVLKCSNCGFEADRDVVGSWNIRLRALKMWGVTVPLESPPMKTGGGKVIRYDSFTCFKSSG

SEQ ID NO: 660 - protein, 351 aa, Paenibacillus forsythiae
MQTVTIQIRIFPAHPSVLVDMGNEYIRTVNELTEQAEASGTFPKLTSKTVHANLPSAVKNQLIRDAKSLFQKSKKNKKRPILKKRVYYVNNQNYAIGDDSLSFPVVMDGKVQRLVVPALLSDRERDMLSNSKHGLLRVVQKSAKWFVQVSIVRPTEQAAGDGIMGVDLGLKVPAVVVTSSGKTRFCGNGRKNKFIRRKYNTHRRKLGKLKKQSAIRKQRDKESRYMKDQNHKISRQIVNMAIQEKVSIIKLEKLADIRKTTRTSRKNAKNLHSWSFYQLQTFITYKAALAGIKVIEVNPAYTSQTCPSCGQRNKAKDRAYQCDCGYTAHRDRVGAINIMHKPVADGNSLSA

SEQ ID NO: 661 - protein, 393 aa, Thermococcus peptonophilus
MPSETIKLTAKFKLKNPPEGLNDLFSTYREIVNYLISYAFENHITSFYRLKKETYKSLRKEYPELPSHYHYTATQMATMIYRSYRKRKKKGKAKGKPVFKKEAIMLDDHLFKLDLDAGIIKLSTPKGRIELEFCSAKYHEKFKDWKIGQAWLVRTPKGVFINVVFSREVEVREPEAFVGVDLNENNVTLSLPNGEFVQIITHEKEIRTGYFVKRRKIQKKLRAGKKRKELLEKYGQRERNRRDDLYHKLANKIVELAEKYGGIALEDLTEIRDSIRYSAEVNGRLHRWSFRKLQSIIEYKAKLKGIKVVFVNPAFTSSLCPVCGEKLSPNGHRVLKCPKCGFEADRDVVGSWNIRLKALKMWGVSVPPESPTMKTGVGKVSRSDAYELYANYG

SEQ ID NO: 662 - protein, 363 aa, Mesotoga
MQITVKIKLEPTREQDTLLQATTQEYIRLVNHIVADFVKSDTPLKYTSKTVVAELPSAVKNQAIQDAKSVFEKYKKNVCANARLKPEDQKEVRVPILKKPVGIWNNQNYSLKENILSFPVLIADKSKRIEVKAVLTDYQRERLNGKLGSLRITQKSGKYIAQIAVEMDEEQSKTSNKIMGVDLGLKNPAVAVVEGGKTKFIGNGRQNKFIKRKHRSVRRKLGELKKLKAIKKRHDKEQRWMKDQDHKISRRIVNSAKENHVAVIRMERLTNIRNTAKTSRKNEKNLHTWSFYRLAKYIEYKAILAGIKIEYVNPEYTSQKCPKCGKRNKANDRKYVCGCGFKTHRDRLGAINIISATVADGVA

SEQ ID NO: 663 - protein, 399 aa, Methanocaldococcus sp. FS406-22
MSNEYLETIKLTARFKIKQTPNEIVGLFSTYKTIVNELLNYAFENNITSFKRLKSEKYKELREKYQKLPSHYLYTACQITTSIFKSWRKRHRKGRASKKPDFKGSVIMLDDHLFRLDLDNGLARISTPKGRVEVELFVSEYHKKFKDWKVGQAWIVRRKDAYYLNVVFSKNVLIKEGESVVGVDLNENNVTIATTNGIIQIITNERTVRTSYYVKRRKIQKKVENEDKKKELLEKYGNRERNKITDIYHKVVNKIIEIAKSVNGVIALEDLKEIRNKIKYSKKLNGRLHRWSFRRLQEVIKYKAKLNGIKVIFVNPHYTSSRCPICGGKMSPNGHRVLKCEDCGCILDRDVVGSLNIMLRGFKLLFNKPKDVGSPVPPESPLLGEDSPLQIIQQIIQMF

SEQ ID NO: 664 - protein, 382 aa, Staphylothermus hellenicus
MTGKFKIKENVEIDRLFKIYREIVNYLINYAYENNITSFYKLKSKTYRNLREKYPNLPSHYIYTACQIATSIYRSYRKKKRRGEARNKPVFKKDSIMLDDHLFKLDIEKGVLKLSTPKGRITLKVYVSNYHMKFKDWRTGQAWLVKKDNGIFLNVVFSREVEIGEPKDFIGVDLNENNVTIALPNGFARFETREREIRTAYYVKRRKIQKKIRAGKKRKKLLEKYGKRERNRLNDLYHKLANKIVELADGYGIALENLKNIRKSIRYSKEINGRLHRWSFRRLQSIIEYKAKLKGIKVVYVDPSYTSSLCPICRGKLSPNGHRVLKCMRCGFEADRDIIGSLNIRLKALKMWGVSVPPESPSMKPERGRLAVIINTYNKSYG

SEQ ID NO: 665 - protein, 392 aa, Thermococcus sp. 2319x1
MLSGTIKLTAKFKLKNPPEGLDDLFSLYREIVNFLLTYAYENNITSFYRLKKETYKELRGKYPQLPSHYLYTACQMATSIYKSYRKRKRKGKANGKPVFKKEVIMLDDHLFKLDLEAGVIKFSTPSGRIPLEFYPAKYHEKFESWRVGQAWLVKTPEGVFINVVFSREVEVGEPETLVGVDLNENNVTLSLPNGGFVQIITHEREIRTGYFVKRRKIQKKLRTGKKRKELLEKYGLRERNRLNDLYHKLANKIVELAEKYGGIALEDLTEIRDSIRYSAEMNGRLHRWSFRKLQSIIEYKAKLKGVRVVFVNPAFTSSLCPICGEKLSPNGCRVLKCLNCGFEADRDVVGSWNIRLRALKMWGVSVPPESHPMKPEGGSLPVTKLTPYTLYG

SEQ ID NO: 666 - protein, 360 aa, Armatimonadetes bacterium 13_1_40CM_64_14
MDHVETVRLHPPDPAQLIAWLERFNAAANWLSGVAFRERLWHWLPLQRRAYREVRERFQIPAAATVVVIRKVAYAYRNKQRRQHQATFRRRGAIPIYKHRYKRDGTVSMYGFRIPFTARPQAWLSSRHQAVLCYRRGKFILHQVVEVDVPPPAPVQDYLGCDLGTVNLLTDSEAEAYSGQAVEEKRRIYVHRRARLQKRGTRAARRKLRQISGRQGRYQRDVNHRIAKRVVAKAQRLCCGIALEDLRGIRDRIKARRRQRARLHNWAFGQLRQFIVYKAAKAGIPVVFVDPANTSRTCPVCGHVDKRNRRSQAAFSCRRCGHEEPADVIAARNVRAWARGDAPMVASARAATSPHPTSRG

SEQ ID NO: 667 - protein, 392 aa, Staphylothermus hellenicus DSM 12710
MLNRRSETVKMTGKFKIKENVEIDRLFKIYREIVNYLINYAYENNITSFYKLKSKTYRNLREKYPNLPSHYIYTACQIATSIYRSYRKKKRRGEARNKPVFKKDSIMLDDHLFKLDIEKGVLKLSTPKGRITLKVYVSNYHMKFKDWRTGQAWLVKKDNGIFLNVVFSREVEIGEPKDFIGVDLNENNVTIALPNGFARFETREREIRTAYYVKRRKIQKKIRAGKKRKKLLEKYGKRERNRLNDLYHKLANKIVELADGYGIALENLKNIRKSIRYSKEINGRLHRWSFRRLQSIIEYKAKLKGIKVVYVDPSYTSSLCPICRGKLSPNGHRVLKCMRCGFEADRDIIGSLNIRLKALKMWGVSVPPESPSMKPERGRLAVIINTYNKSYG

SEQ ID NO: 668 - protein, 257 aa, Haloterrigena salina
MGTLHYDEQEDDFYLHIVIQKEVEEREGDRILGVDLNLKNVAVTSTGSFYDGGKLLWGQNHYFRVRRSLQDKGTRSAKQALARLSGRENRFVLDRLHTISRRIVEEARHYDCSYIAVEDLTHIRERMDASDDQLKRQMHQWAFRELQEMIQWKATEYGIRVESVNPAFSSQTCSKCGHQSSTNRNSDGWFECNECGYEIDGDYNASKNIGMRLLSLPEGKRPSGLGDGHLALKSGTVTLNGDYTAYDTVSAEGESHA

SEQ ID NO: 669 - protein, 392 aa, Thermococcus sp. PK
MPSETIKLTAKFKLKTEPEGLEDLFSLYQEIVNFLITYAFENNITSFYRLKKETYKSLREQYPELPSHYIYTACQMATSIYKSYRKRKRRGKANGKPTFKKKVIMLDDHLFKLDLEGGFIKLSTPSGRLELEFYRAKYHEKFREWKIGQAWLVKNPKGVFLHVVFSKEVEVRESKAVVGVDLNENNVTLSLPDGNFIQIITHEKEIRTGYFVKRRKIQRKLRAGKKREELLEKYGRRERNRLNDLYHKLANKIVELAEKYGGITLEDLTEIRDSIRYSAEMNGRLHRWSFRRLQAIIEYKAKLKGVSVVFVDPAYSSSLCPICGGKLVPNGHRVLKCECGFEADRDVVGSWNIRLKALKMWGVSVPPESPPMKTGGGKPTRYEINALHALYW

SEQ ID NO: 670 - protein, 385 aa, Streptomyces sp. CB01883
MKIVTQVKLVPETDQAAALRSTLRTVNDLATWVSDVAFVNDVPREYDLRRHTYAHLKSEGLGAQAAQHVIKKVRDAYTTLHANLRAGNLGKPGSKRRRKAESKPITFRPEAAQPYDDRCLSWQYDTQTVSIWTTAGRIKNVRFACSADAFKVLQHYRKGESDLIERDGIFYLTATCEIPEAETYEPDRFIGVDLGIVNIATTSTGYQAAGRGLNRYRKRQLALRSKLQKKRTKSAKRRLKERSRREQRHVKNTNHIIAKTIVTEAERTSAGICLEQLKGIRQRVRLRKPQRVALHSWAFAQLGDFIVYKAKRAGVPLVFVDPSYTSQTCAECGHVDKRNRVDQRLFICRKCGVVAHADRNASHNIATRGETVWNAGRESRVPATP

SEQ ID NO: 671 - protein, 358 aa, Gracilibacillus timonensis
MSQTITIKVKLIPTKEQASILSEMSKTYISVINTLVSEMVDEKKSTKKSSKDISVSLPSAVKNQAIKDAKSVFKKGKKSKYKVIPILKKTVCVWNNQNYSFDSTHISMPIMMDGKAKKIPIRALFMDKDNRNMDLLKHKLGTLRITKKANKWMAQISVTIPTVQGTGLKVMGVDLGLKVPAVAVTDDEKVRFFGNGRQNKYVKRKFRSERKALGKRKKLNAIRNSKDKEQRWMKDQDHQVSRAIVNFAKDHRVSVIRLEQLANIRQTARTSRKNEKNLHSWSFYRLSQFIEYKANLEGIKVEYVNPAYTSQTCPTCFEKNKAQDRKYTCKCGFKKHRDLVGAMNIRYAPVIDGNSQSA

SEQ ID NO: 672 - protein, 404 aa, Pyrococcus furiosus
MPSETIKLTAKFKLKEIPNGLDVLFSTYREIVNFLISYAYENNITSFYRLKKETYKNLRKEYPELPSHYHYTAIDMATKIYRGYRKRRGKAKGKPVFKKEVIMLDDHLFKLDFEKRIVKLSTPSGRIELEFYPAKYHEKFKGWKVGQAWLVKTPKGLFINVVFSREVEIREPENFIGVDLNENNVTLCLPKGEFIQIITHEREIRTGYFVKRRKIQKNLRVGKKREELLEKYGSRERNRVDDLYHKLANKIVELAEKYGGIALEDLTEIRDSIRYSAELNGRLHRWSFRKLQRIIEYKAKLRGIKVIFVNPAYTSTLCPICGGKLSPNGHRVLKCKCGFEADRDVVGSWNVRLKALKMWGVTVPPESHPMKKGGWKVSRIDITQITADQNGYFMRRLRRALLLQ

SEQ ID NO: 673 - protein, 408 aa, Haloterrigena salina JCM 13891
MEVQRTVRVKLDVPDERRDHLHQTIEQFDTAVNYSIENGRNDDGYFITAKTNIHDQVYHDLRDVTDLPANLCVRAYSKAVEMIKSTVADWKNGNSRPVPSFDQPIVVYDKRILTINERSATLSTVESRVEVGFDIGEYQADYLDDDDYEKRMGTLHYDEQEDDFYLHIVIQKEVEEREGDRILGVDLNLKNVAVTSTGSFYDGGKLLWGQNHYFRVRRSLQDKGTRSAKQALARLSGRENRFVLDRLHTISRRIVEEARHYDCSYIAVEDLTHIRERMDASDDQLKRQMHQWAFRELQEMIQWKATEYGIRVESVNPAFSSQTCSKCGHQSSTNRNSDGWFECNECGYEIDGDYNASKNIGMRLLSLPEGKRPSGLGDGHLALKSGTVTLNGDYTAYDTVSAEGESHA

SEQ ID NO: 674 - protein, 388 aa, Streptomyces diastatochromogenes
MLLVKVVTQVKLIPDAAQAPAIAATLYTFNSEANWVSEVAFMNGVPREYALRKLAYAQLKERGLGAQVAQHVIKKVRDAYTTLHAGLRAGNLGRPGSKRRRKAEAKPVVFRPEAAQPYDDRCLSWQYDAQTVSIWTTAGRLKNVRFACSADALKMLQQYRKGESDLIERDGVFYLVAVCEVPEAERYEPDGFIGVDLGIANIATTSTGYQAAGRGLNRYRKRQLALRAKLQKKRTKSAKRRLKERSRREARHVKNTNHIIAKTIVTEAERTSAGISLEELKGIRQRVRLRKPQRVALHSWAFAQLGDFIVYKARRAGVPVVYVDPAYTSQQCCECGHIDKKNRASQALFTCRNCGVVAHADRNASHNIARKGDAVWIAGRESRVPATP

SEQ ID NO: 675 - protein, 401 aa, Methanotorris formicicus
MSNEYLETVKLTARFKIKEIPNELTNIFPTYKTIVNNLLNYAFKNNITSFKRLKSEKYKDLRGKYKKLPSHYLYTACQMATSIFKSWRKRHRKGKASKKPDFKGSVIMLDDHLFKLDLDKGLARISTPYGRVEVELYSSDYHKKFKDWKVGQAWIVRKKNDYYLNVVFSKNILIKEGENVVGVDLNENNVTIATDENIIQIITNERTIRTSYYVKRRKIQEKIRLGDKKKELLEKYGERERNKIVDIYHKVANKIIEIAKKVGGVIALENLKEIREKVNYFKKLNGRLHRWSFRKLQEFIKYKAKLNGVRVVFVNPHYTSSRCPICGGRMSPNGHRVLKCECCGCIADRDVVGSLNIMIRGFKAIKPKDVGSSVPPESYPMKLGGWKVIRYACFNCFKISG

SEQ ID NO: 676 - protein, 388 aa, Actinobacteria bacterium OK006
MLLVKVVTQVKLIPDAAQAPAIAATLYTFNSEANWVSEVAFMNGVPREYALRKLAYAQLKERGLGAQVAQHVIKKVRDAYTTLHAGLRAGNLGRPGSKRRRKAEAKPVVFRPEAAQPYDDRCLSWQYDAQTVSIWTTAGRLKNVRFACSADALKMLQQYRKGESDLIERDGVFYLVAVCEVPEAERYEPDGFIGVDLGIANIATTSTGYQAAGRGLSRYRKRQLALRAKLQKKRTKSAKRRLKERSRREARHVKNTNHIIAKTIVTEAERTSAGISLEELKGIRQRVRLRKPQRVALHSWAFAQLGDFIVYKARRAGVPVVYVDPAYTSQQCCECGHIDKKNRASQALFTCRNCGVVAHADRNASHNIARKGDAVWIAGRESRVPATP

SEQ ID NO: 677 - protein, 385 aa, Actinobacteria bacterium OK006
MKVVTQVKLIPDAAQAPAIAATLYTFNSEANWVSEVAFMNGVPREYALRKLAYAQLKERGLGAQVAQHVIKKVRDAYTTLHAGLRAGNLGRPGSKRRRKAEAKPVVFRPEAAQPYDDRCLSWQYDAQTVSIWTTAGRLKNVRFACSADALKMLQQYRKGESDLIERDGVFYLVAVCEVPEAERYEPDGFIGVDLGIANIATTSTGYQAAGRGLSRYRKRQLALRAKLQKKRTKSAKRRLKERSRREARHVKNTNHIIAKTIVTEAERTSAGISLEELKGIRQRVRLRKPQRVALHSWAFAQLGDFIVYKARRAGVPVVYVDPAYTSQQCCECGHIDKKNRASQALFTCRNCGVVAHADRNASHNIARKGDAVWIAGRESRVPATP

SEQ ID NO: 678 - protein, 397 aa, Thermococcus litoralis
MPIETIKLTAKLKLKEIPNGLDALFPTYREIVNFLISYAFENNITSFYRLKKETYKSLRKEYPELPSHYHYTATQMATMIYKSYRKRKKKGKANGKPVFKKEVIMLDDHLFKLNLEAGVVKLSTPSGRIELEFYPAKYHEKFGDWKIGQAWLVRTQKGVFINVVFSREVEVREPETFVGVDLNENNVTLSLPNGEFVQIITHERELRTGYFVKRRKIQKKLRAGKKREELLEKYGRRERNRLDDLYHKLANKIVELAEKYGGIALEDLTEIRDSIRYSAEMNGRLHRWSFRKLQSIIEYKAKLKGVRVVFVDPAYTSSLCPVCGGNLSPNGHRVLKCECGFEADRDVVGSWNISLRALKMWGVTVPPESQPMKMGGWKVSRADVYELYKLRLTRTDV

SEQ ID NO: 679 - protein, 388 aa, Streptomyces hokutonensis
MIVVKIVTQVKLMPEAQQAAALSATLRTVNDLACWVSAVAFAHGVPREYELRKHTYPRLKAEGLGAQSAQHTIKKVRDAYTTLRANIRAGNLGKPKSKRRRKAESKPITFRPDAAQPYDDRCMSWQYDQRTVSIWTTEGRLKAVRFVCSADALKVLQQYRKGESDLIERDGVFYLVATCEVPEAETYEPDGFIGVDLGIVNIATTSTGYQAAGRALNRYRKRQLALRAKLQKKRTKSAKRRLKERSRREARHVKNTNHIIAKTIVTEAERTSAGISLEELKGIRQRVRLRKPQRVALHSWSFAQLGGFIVYKAKRAGVPLVFVDPAYTSQTCAECGHVDKRNRIDQGLFICRGCGVVAHADRNASHNIATRGEIVWNAGRESRVPATR

SEQ ID NO: 680 - protein, 275 aa, Halorubrum sp. Eb13
TSNKLSNSDPRAVIGFNKAVRTVWAGEEWELHFVCKVEIDVAEAPGEKTVGVDLGINNFAALAYEDGHSDLYPLNCLKQDDYYFSKRIARCDDSNSEQATQLNQKKSARRTHYFHTLSKHIVQRCVEEGVGTIVVGDLSGIREDDDTDESKNWGKHGNLDLHSWAFDRFTDLLEYKAEMEGIVVEEVSEEDTSKSCSCCGRKRDANRAERGLYVCDDCGTVANADVNDAENIRQKVSPSSPNLSVNGSNGWLAQPSTFLFDKEAGAFAPQERVTS

SEQ ID NO: 681 - protein, 348 aa, Bacillus sp. OV322
MLPTKEQIQLLKQSSHEYIKVINTLVIEMVEAKKSTKKTTKDVPAILPSAVKNQAIKDAKSVFQKVKKAKYQIVPVLKKPVCVWNNQNYSFDFTHISIAFIVNGKSTRLKVRALLVDKDNRNFDLLKHKLGTLRITKKSNKWIAQISVTIPLDEKPGTKIMGVDLGLKVPAVAVTDDEKVRFFGNGKQNKYMKRKFRTARKKLGIKKKLSAIRQLDDKEQKWMKDQDHKVSRAIVDFAKDHNISVIRLEQLTNIRQTARTSRKNEKNLHTWSFYRLAQFIEYKAALVGIRVEYVNPAYTSQTCPTCTEKNKAKDRKYVCNCGFNKHRDLVGAMNIRYAPVVDGDSQPA

SEQ ID NO: 682 - protein, 309 aa, Streptomyces sp. NRRL F-5122
MAFDRDLKRRNGLQEAVYHRIKADFDLGAQAAVRTIKKVCDAYATLKANIKAGNLGPEGGKRRIRAENRPVRFREGAAQPYDDRMLTWNLDERTVSIWTVAGRLKGIAFVCSPEAMKLLASRKGESDLVMRDGMFFLTATVDVPEPAPYEPTGFLGVDLGIVNIATTSDGQIMSGRQVNRYRKRHRDLRTTLQKKRTKSATRRLKSIRRRESRYATQRNHIIAKKLVHTAERTLRGIGLEDLSGIRQRVTARKDQRARLHSWAFAQLGAFIEYKARRAGVPVVHVDPRNTSRQCSECWHTHRSNRIDQA

SEQ ID NO: 683 - protein, 318 aa, Paenibacillus riograndensis
MSQTLTIKIKLLPTREQASMVKNQAIKDAKSVFKKAKKSKFTIVPVLKKPVCIWNNQNYSFDFTHISMPLMMNGKVAKTPIRALLIDKDNRNLGLLKHKSGTLRITQKSEKWIAQISVTVPTSEKTGTKIMGVDLGLKVPAVAVTDDDQTCFFGNERQNKYIRRKFQSKRKKLGQRKKLNAIVKLDDKEQRYMKDQDHKISRAIVQFAVEHQISVIRLEQLANIRQTARTSRKNEKSIHMWSFYRLSQFIEYKAKLAGVKVEYVNPAHTSRTCPKCSEKNKAQDRKYICSCGFETHRDRVGAMNIRYAPVIDGNSQSA

SEQ ID NO: 684 - protein, 426 aa, Halorubrum tropicale
  misc_feature (260)..(260): Xaa can be any naturally occurring amino acid
MAKQVVTRTHTASIQNQSRVQDDLDSLGFAASKLWNVGRWTCSRIWDEIDHIPNHTELTTYLKTHERYADLHSQSSQRVLQELAEAFNGWYGKRRNGDTRANPPGYRKHGDEHPRSTVMFKAAGFKLDTQYNRVRLSKGSNLKEYWSDFILCKYQTRPDIDLSTVENVQQVRAVWTGEKWELHFVCKVEVEVAEAPGEKAVGVDLGINNFAALAYEDGHSELYPLNCLKQDBYYFSKRIARCDDSNSEQATRLNQKKSAXRTHYFHTLSKHIVERCVEQGVGTIVVGDLSGIREEDDSDESKNWGKHGNLDLHSWAFDRFTDLLEYKAEMEGITVEEVSEEDTSKSCSCCGRKRDANRVERGLYVCDECGTVANADMNGAENIRQKVSPSPAMDGGDRSNGWLAQPSTFLFDKETGAFAPQERATW

SEQ ID NO: 685 - protein, 360 aa, Bacillus pseudomycoides
MSQTITVKVKLVPTKEQVKLLEESGHEYIKVINALVSEMVEAKKSTKKSTKDIEANIPSAVKNQAIKDAKSVFSTKVKKSKYKIIPVLKKPVCVWNNQNYSFDFAHISIPFMVKGKSTRLKIRALLADKNNRNFDLLKHHKLGTLRIMKKSHKWVAQISVTIPTNENTGTQIMGVDLGLKVPAVAVTDDDKVRFFGNGRQNKYIKRKFRSVRKKLGEQKKLNAIRNFDDKEQRYMKDQDHKVSRAIINFAKENNISVIRLEQLTNIRQTARTSRKNEKNLHSWSFYRLSQFIEYKANLEGIKVEFVNPAYTSQTCPVCSEQNKAQDRKYKCKCGFEKHRDIVGAMNIRYVTVIDGNSQSA

SEQ ID NO: 686 - protein, 393 aa, Thermococcus litoralis DSM 5473
  misc_feature (175)..(178): Xaa can be any naturally occurring amino acid
  misc_feature (208)..(208): Xaa can be any naturally occurring amino acid
MPSETIKLTAKFKLKEIPNGLDVLFSTYREIVNYLIGYAFENNVTSFYKLKKETYKSLRKEYPDLPSHYHYTATQMATMIYKSYRKRRKKGKAKGKPVFKKDAIMLDDHLFKLDLKAGVIKLSTPMGKIKLEFYPAKYHEKFGDWKIGQAWLVRTQKGVFINVVFSREVEVREPXXXXGVDLNENNVTLSLPNGEFVQIITHEKDIRXGYFVKRRKIQKKLRTGKKREELLEKYGRRERNRLNDLYHKLANKIVELAEKYGGIALEDLTEIRDSIRYSAEMNGRLHRWSFRKLQSIIEYKAKLKGVRVVFVNPAYTSSLCPVCGGKLSPKGHRVLKCSNCGFEADRDVIGSWNISLRALKMWGVSVPPESQPMKMGGWKVIRYDSFMCFKSGG

SEQ ID NO: 687 - protein, 355 aa, Nitrosopumilales archaeon CG_4_9_14_0_8_um_filter_34_10
MILTYNIKHERDFSSELIQAKKIADFAIRTKSNSSKDVRHLGLKSAIANQILRKYRKSGIKKTSSVNLTVPGQSVKFDNTEKLAKISCLNLELDCMYLPEFKKIRQIEIGKTLAHVSVEISEPETRASEKFIGIDCNTTGHAAVIAIPHTGKIHKLGKSAIHTHTKYKQIRKKLQKKGKFSLLKKIKDKESHILKNINHHISKKIIQIAVSEKSGIRFEDLKGIRKNKKYSRKFRYSLNSWSYYQLQQFTQYKAKKQGIEVAYVAPAYTSQTCSRCGSLGDRDGKKFQCVCGHADHADVNASFNIGKPVSHCLIDPTRIKSKSQLHKESDLCKGSTDTPQTAMSEMMITVEPMKL

SEQ ID NO: 688 - protein, 371 aa, Halobacillus hunanensis
MATKTILVKLKHVTKKKHKQFMDEQAVYASCVNHCVERLLNGEKLSSENISFPLKSAIRNEGIRRARKAVSDFKKGLAKTIPVFRNSLTIKINNQNWNTVDQNGRWYIAFTSNQGKKALPVVETKDVQSYFPFLTTKTREFRGTIELLRKGRRWYVAIPIQVSSDLDLENSHPSVTKPLMDYTSIGVDLGLRHLVVLSEPTSGKRQFFSGKEVGYKRRHFRSLRRSLGKKKAQRAMERVGQKESRWMKDYNRKLAKDIVTFAQQFEKPMIKLEQLDNIRKTCRSMNRADKTIHSWAFYQLKQCIKERAATFNIPVVDIDPHQTSQTCFACKHAERSNRKRDFFTCKKCGHKAHADLNASRNIATSTNLAAS

SEQ ID NO: 689 - protein, 407 aa, Halomonas sp. GFAJ-1
MTVAYTHWPTVGASQGNQAVKIIEALIHPTAKRPQVRYTYFANRYYKFPSYLRRVAIMDAVGQVRSFVTRFDQWRCGQRKHPHAKPPRLTSSTKTFPSLYGSQCAKINADATHAFIKVRWQNDWIWMRFGLKGTCRFRGKGKAKSPLLTTNGRQWQLSLPEQFEPPKPVKGAPDRVLAVDVGINTAATWAVVDTQGTVHARGFISRTDKDREYRLMARIRQTAKKHTRHGSRLPPGFCRRDHQRLSHLADNQAHQISRQLVNLAVDHHCQAIAVENLKGWRPKAGQKRTPMKARFHRWFHRQLVARIGSKAVEVGLRCVAVYARGTSRHAFDGSGQVKRDKSNYSQCTFRSGKRYHADLNAAYNIAARGHVVFQGGQRKPTARVRSQMSTHIPRTPVTLSTLWPQSA

SEQ ID NO: 690 - protein, 380 aa, Thermoactinospora rubra
MRLVVQVKPLPTPEQAAALEATLHTVNRAATLVARIAHQQRCFRNFDLRKHAYARIKAEFGLAAQAAQHVIKKVADAYRTLHANLAVGNLGKPGSRRRRAAETRPIVFRSRAAQPYDDRCLSWQHATRTVSIWTVAGRLKAVAFTGSARQLALLAEHRRGESDLIWREGAWYLYATVEVPDRPVAAPDGFAGVDLGIANIATTSDGIRHSGKHLNALRHRHRELRRRLQAKKTKSAKRLLKRRRRKEARLAAQVDHAIAKQIVTEAERTGRGIALEDLGGIRERVRLRKPQRVTLHSWSFHQLGAFITSKAARAGVAVIFVKAAYTSQECSACHHIDKRNRPDQATFSCTSCGFAEHADVNAARTIASRGETGWAVSHAA

SEQ ID NO: 691 - protein, 391 aa, Sutterella wadsworthensis
MSVRKPSGITLKGLNISKGAGKLVRRKVDVRTVCIALEVDADASEKMHQTRRLYGQACNLLVPIVVSDTDRKKRLWQRYNLHKAAYPMVRTKMSVLGAQLACNVMRSVSSMYQSWISNHPNFSKDKKMVLPSISFRNPVVHLDKNTIRFFNNYTEASVYTVNGRVGVRLRPGKFQLSQLAGFLAEELAGTSKENRIYRLGECNLVWKCGIKGTPSRWELHIAIEKKLKEVSLDNLSLNQVMGVDVGENNAAALSTGRIFKAGKMKDDRDKYLSSRARFQRNGSRSARQALRKASGREKRHVEQINDEISKSIIEDAAERNIRLIVLEDLTNIRERIKAGLKVRARLHRWPFRELQQKIVDKACRAGIEVIFADPRYTSQTCPHCNAIGRSA

SEQ ID NO: 692 - protein, 393 aa, Pyrococcus kukulkanii
MPSETIKLTAKFKLKKTPKGLDDLFSAYREIVNFLITYAFENNITSFYRLKKGTYKELRKKYPQLPSHYIYTACQMATSIFKSYRKRKRKGKANEKPVFKKEVIMLDDHLFRLDLEKGVIKLSTPKGWLNLKFYPAKYHEKFKDWKVGQAWLVKTPKGVFINVVFSKEVEIREPKAFVGVDLNENNVTLALPNGEFVQVITHEREIRTGYFVKRRRIQKKIRTGKRRKELLQKYGEREKNRLNDLYHKIANIIVGFAERYGGIALEDLSGIRGSIRYSVELNGRLHRWSFRKLQSIIEYKAKLKGVRVVFVNPAHTSSLCPICGGKLSPNGHRVLKCKKCGFEADRDVVGSWNIRLRALKMWGVSVPPESPPMKTGGGKPTRYEINTLHTLNG

SEQ ID NO: 693 - protein, 165 aa, Sharpea azabuensis
RKNKYMRRHYRCLRKKLQKAKHIDAVKRINDKEQRIMKDIDHKLSHDVVETAVAHNVKTIKLERLANIRSTTRTSRKNNHSLHNWSFYRLAQFIEYKAKLAGIAVEHVNPAYTSQTCPVCSHVHHANDRNYTCKCGFHIHRDILGAMNICNSTEYVGDSNIRHTA

SEQ ID NO: 694 - protein, 427 aa, Sutterella sp. KLE1602
MSVRKPSGITLKGLNISKGAGKLVRRKVDVRTVCIALEVDADASEKMHQTRRLYGQACNLLVPIVVSDTDRKKRLWQRYNLHKAAYPMVRTKMSVLGAQLACNVMRSVSSMYQSWISNHPNFSKDKKMVLPSISFRNPVVHLDKNTIRFFNNYTEASVYTVNGRVGVRLRPGKFQLSQLAGFLAEELAGTSKENRIYRLGECNLVWKCGIKGTPSRWELHIAIEKKLEEVSLDNLSLNQVMGVDVGENNAAALSTGRIFKAGKMKDDRDKYLSSRARFQRNGSRSARQALRKASGREKRHVEQINDEISKSIIEDAAERNIRLIVLEDLTDIRERIKAGQKVRARLHRWPFRELQQKIVDKACRAGIEVIFVDPRYTSQTCPHCNAIGTRQKHRFVCKNCGYRAHSDLNGGRNLQRLGCLLITQGLV

SEQ ID NO: 695 - protein, 361 aa, Armatimonadetes bacterium 13_1_40CM_64_14
MNQVETVRLHPPDPAQLIAWLERFNAATNWLSGVAFRERLWHWLPLQRRAYREVRERFQLPSAATVVVIRKVAYAYRNTQRRQHQATFRRRGAIPVYRHQYKRDGTVSLYGFRIPFTARPRVELSSRHQAVLCYRRGKFVLHQVVEVDVPAPAPVQDYLGCDLGTTNLLTDSEEEAYSGRAVEEKRRIYVHRRARLQKRGTRAARRKLRKISGRQRRYQRDVNHGIAKRVVAKAQRLCCGIALEDLRGIRDRIKARRRQRARLHNWAFGQLRQFIVYKAAQAGVPVVFVDPANTSRTCPVCGHVDKRNRRSQAEFNCRRCGHAGPADVIAARNIRAWARGDAPMVASARAATSPPPYVEGG

SEQ ID NO: 696 - protein, 374 aa, Methylobacter sp.
MKRTISIKLDPTTEQSALLDALQAEFARACNIVVGFSAPVKCSNRVALHHLCYYQVREQVPALGSQMVCNAIANVAQSYKSLVANEPKLRKEEWPVINFRQTASVHFDKRTYSFKNDTLSLFTLDGRIAVNYIFGKHQANLLNSGLTKEAELLKRKGQWYFNLVIDIPDAAPSTGNGSMGVDVGENNIAATSTGKVFGGGELRHKRDKFLAHRKRLQRNGSNSAKQLLKKISGKEVAHVKHVNHEISKAIVQEAIAANASEIRLEDLTNIRDNIKAGRRVRTRLHRWSFRQLQDFVAYKAQAVGIEIKYINPAYTSKSCSVCDAIGTRVKHKFSCKNCGHLSHSDVNAASNIAKFDRLFSPSRGVVSRPNVERF

SEQ ID NO: 697 - protein, 295 aa, Thermoactinospora rubra
MLKLAPDAEQAQSLLATMRACNAAANRAAEVAYDQRILTFKGRDWVSILTLTGRILVPVAYQGRWLSASGTTMRGQADLVCRDGTLYLAVVIDVPEPPKDGEPDGWLGVDLGIVNLATDSTGQAHSGKAVRAVRYRNLMLRRRLQQKATKSAKRLLKKRRRAEARFARNTNHVISKHLVGKAQDTRSGIALEDLQGIRDRVTVTRAQRADLHSWGFHQLRAFITYKAAIAGVPVRLVDPRNTSRTCPACGHCAKRNRPHRDSFLCVACGFAGPADHIAAINIGRRAVSHAADDAA

SEQ ID NO: 698 - protein, 393 aa, Thermococcus eurythermalis
MPSETIKLTAKFKLKGTPDGLDDLFSTYREIVNFLITHAFENNITSFYRLKKETYKGLRKEYPELPSHYLYTGCQMATAIFKSFRKRKKKGKARGRPVFKKEVIMLDDHLFKLDLENKTVKLSTPSGRIQLEFYPARYHEKFKDWKVGQAWLVRTSKGVFLNVVFSKEVEVKEPKAFVGMDLNENNITLSLPNGEFLQIITHEREIRTGYFVKRRKIQRKIRSGKRRKKLLEKYGEREKNRLNDLYHKLANKIVEVAEKYGGIALEDLTEIRESIRYSAEMNGRLHRWSFRKLQSIIEYKAKLRGVKVVFVNPAHTSSLCPVCGGKLSPNGHRVLKCSNCGFEADRDVIGSWNIRLRALKMWGVSVPPESPTMKTGVGKVSRNDVYELYTSYG

SEQ ID NO: 699 - protein, 358 aa, Exiguobacterium sp. U13-1
MSQVVTVEVRIYATRRQDAILKRMGKTYIQTANRVVANMVASEDGKRWSSKDIDTPLPSAVKNQLAGDAVGIYKKARKEEFKRIPVLKKPVCVWNNQNYSFDFESISFPVWMDGKSVKMRFRAPMVDKDNRNTRLLANKLGTLRVTKKGRKWIAQISVHVPTVPRTGVRMMGVDLGLKVPAVAVTDDDTTRFFGNGRKNKYMKRKFRAERKALGKKKKPRAIKRRNQKEQRWMRDKDHKVSRAIVDFARQKKISVIRLELLANIRQTARTSRKNNQNLHSWSFYRLASFIEYKAALSGIKVEYVNPAYTSQTCPSCSVRNKVRDRVYTCACGFKGHRDAVGAMNIRYAPVMDGNSPSA

SEQ ID NO: 700 - protein, 398 aa, Sutterella sp. KLE1602
MRTVCIALEVDADASEKMHQTRRLYGQACNLLVPIVVSDTDRKKRLWQRYNLHKAAYPMVRTKMSVLGAQLACNVMRSVSSMYQSWISNHPNFSKDKKMVLPSISFRNPVVHLDKNTIRFFNNYTEASVYTVNGRVGVRLRPGKFQLSQLAGFLAEELAGTSKENRIYRLGECNLVWKCGIKGTPSRWELHIAIEKKLEEVSLDNLSLNQVMGVDVGENNAAALSTGRIFKAGKMKDDRDKYLSSRARFQRNGSRSARQALRKASGREKRHVEQINDEISKSIIEDAAERNIRLIVLEDLTDIRERIKAGQKVRARLHRWPFRELQQKIVDKACRAGIEVIFVDPRYTSQTCPHCNAIGTRQKHRFVCKNCGYRAHSDLNGGRNLQRLGCLLITQGLV

SEQ ID NO: 701 - protein, 129 aa, Sharpea azabuensis
MKDIDHKLSHDVVETAVAHNVKTIKLERLANIRSTTRTSRKNNHSLHNWSFYRLAQFIEYKAKLAGIAVEHVNPAYTSQTCPVCGHVHHANDRNYTCKCGFHIHRDILGAMNICNSTEYVGDSNIRHTA

SEQ ID NO: 702 - protein, 132 aa, Sharpea azabuensis
QRIMKDIDHKLSHDVVETAVAHNVKTIKLERLANIRSTTRTSRKNNHSLHNWSFYRLAQFIEYKAKLAGIAVEHVNPAYTSQTCPVCGHVHHANDRNYTCKCGFHIHRDILGAMNICNSTEYVGDSNIRHTA

SEQ ID NO: 703 - protein, 208 aa, Peptococcaceae bacterium CEB3
MGVDLGLIDLAVASILGSTLFFSGAELAYIRRHYAELRKKLQKKGAHKALRKLGNKEHRWIMAINHTISRRIIEFAKAHGVSVIRLEDLRGARWTKSQRKKQRKDAGRSLHSWAFFQLRQFIEYKAALAGIEVELVNPELTSLTCSRCGEVRTSRPAGRWYTCPRCGKVKHIDANAADNIAQAISGLSEEKRAKTILKPKTRRRTTAA

SEQ ID NO: 704 - protein, 266 aa, Streptomyces sp. CB01635
MGERTVSIWTVTGRMKHIAFTGSPVHLAVLEAYRKGESDLLYRDGRWYLIATCEVAEAELDAHPASFVGVDLGIVNIATTSTGARHSGRRLNRRREADRTLRAKLQRKGTKSAKRRAKKHAGKEARRARDINHKISKHIVAEAQRTGRGIALEDLGGIRERARLRKPQRVTLHSWSFHQLGAFIAYKAKRAGVPLVHVDPAYTSQECSQCHHIDRRNRPSQARFACQVCGFVEHADPNSSHNIAARGWWTWVRGAESQAPALTLIA

SEQ ID NO: 705 - protein, 443 aa, Halomonas sp. GFAJ-1
MLIIRSDTLTLQVTSADQRQALANTLALYRRLVRDLMTVAYTHWPTVGASQGNQAVKIIEALIHPTAKRPQVRYTYFANRYYKFPSYLRRVAIMDAVGQVRSFVTRFDQWRCGQRKHPHAKPPRLTSSTKTFPSLYGSQCAKINADATHAFIKVRWQNDWIWMRFGLKGTCRFRGKGKAKSPLLTTNGRQWQLSLPEQFEPPKPVKGAPDRVLAVDVGINTAATWAVVDTQGTVHARGFISRTDKDREYRLMARIRQTAKKHTRHGSRLPPGFCRRDHQRLSHLADNQAHQISRQLVNLAVDHHCQAIAVENLKGWRPKAGQKRTPMKARFHRWFHRQLVARIGSKAVEVGLRCVAVYARGTSRHAFDGSGQVKRDKSNYSQCTFRSGKRYHADLNAAYNIAARGHVVFQGGQRKPTARVRSQMSTHIPRTPVTLSTLWPQSA

SEQ ID NO: 706 - protein, 379 aa, Actinomadura sp. CNU-125
MKLVVQVKLLPDVATEAALRETLQLCNQAADHVSRRAHQSNVKTKAALQRLVYREVKGMGLSAQPAIHCVRKVAEAYAASADEPSTARHGRRPPRPLRAPVRFRKDAAQPFDDRCLSWRLDACTVSIWTVRGRMKNIRFACSTEQLSLLRHHRRGESDLVWRNDSFYLYATCEVPEADEYRPDGFLGVDLGIANIATASDGHRHSGRQLNQTRHRNRRLRSKLQKKGTKSAKRLLRKLSSREARFAADTNHRISAHVVTEAQRTSRGIALEDLTGIRERVRLRKPQRVTLHSWSYAQLGSFIAYKAKRAGVPVVYVDPRHTSQGCSACGHVDKRNRPSQAAFRCTSCGFAEHADVNAARNIAARGAASWAVSHAADDAD

SEQ ID NO: 707 - protein, 346 aa, Paenibacillus beijingensis
MQTVTVQIRIFPNDVSLLKEMGNEYIQTVNRLTEQAETAGVFPKLTSKDVEANLPSAIRNQAIRDARSIHKKTKKQGKRPILKQRAYYVNNQNYTIGQNTVSFPVMADGKVRRLTVSARIEEREQHVLDSGKSGLLKIVEKSGKWYVHLSIELQVKEAAGDITMGIDLGLKVPAVVVTSTGKTRFVGNGRQNKYIRRKYNSRRRKMGKLKKLSAIRKQQNKEHRYITDQNHKISRTIVNLAIEEQVSVIKVEKLTSIRQTTRTSRKNAKNLHNWSFYQLQKFIAYKAALAGIKVMEVNPAYTSQTCPACGKRNKATDRTYRCLCGFHSHRDRVGAVNIMRQPVTDG

SEQ ID NO: 708 - protein, 373 aa, Geobacter sp. DSM 2909
MKRTISIKLVTSPEQEARLLLLQTELARACNHLAGAAAVNRCSNRVKLHHRVYYTVREAMPALGSQMTCNAVAAVVRSYKSLVSNNPGLRKTDWPLITFKSSGSVHFDKRTYSIKGKAISLFTTEGRIIVPMKLGEFQGKYLDIGMPKEAELVCRKGRYYFNLVLDFPDPPKRTTGPVAGVDLGENTIAAISTGKIFGGGKLRHDRDKHLTLRSRLQRNGSQSARQLLKKVSGREARHVRHVNHEVSKAIIAEAVGNECGAITMEDLTNIRKRIKAGKRMRSRLHRWAWAQLQAFIAYKAEAAGIRVEFANPAYTSQTCSVCGCMGTRERHRFSCTCGNLAHSDLNASRNLARLGATAVAPTGAVNRPYVGTA

SEQ ID NO: 709 - protein, 426 aa, Halorubrum chaoviator
MAKQVVTRTYTASIRNQSRVRDDLGALGFAASKLWNVGRWTCSRIWDEIGHIPNHTELTAYLKNHERYDDLHSQSSQRVLQELAEAFSGWYGKRRNGDTRANPPGYRKHGEKHPRSTVTFKTAGFKLDTEYNRVRLSQGSNLKEYWSDFILCKYQTRPDVDLSTVEGVKQVKAVWSGDKWELRFICKVEVDVSESSGEKTVGIDLGITNFAALAYEDGHSELYPLNGLKQDDYYFSKRLAQCDDSNSAQATRLNQKKSNRRTHYFHTLSKHIVQRCVEDDVGTIVIGNLSGIREDDENGESKNWGKHGNLDLHSWAFDRFTELLTYKAEMEGITVEEVSERDTSKSCSCCGRKRKANRVERGLYVCDNCGTTANADVNGAENIRQKVSPSSPNLSVNRSNGWLAQPSTFLFDTETGAFAPQERVTS

SEQ ID NO: 710 - protein, 428 aa, Streptomyces sp. HGB0020
MKLVIRVKLLPTPHQASALQATLHTCNEAANHASRHAFTTGIKRNRELRTQIYTQIKERFSLGAQAAQLAIKKACNAYASLRGSLKAGHLGRPGTKRHTRATNKPITFRPDAAQPYDDRMLSWQTEQRTVSIWTVHGRMKHIPYTGQEDQLLLLAHRRQGQSDLLHHNGQWYLLATIDVPEPPQNPAPHDFIGVDLGIENIATTSTGRRHSGRKINRTRENDRRLYRRLAKKKTRSAKRRAKRHAGKQARRTRDINHKISKHIVTEAQRTGRGIALEDLSGIRERARLKKPQRVTMNSWAFGQLGSFIAYKARKAGVPLVHVSPAYTSQECSQCHHIDKRNRPSQAVFACRSCGFVEHADLNASHVIGRRGWWVWVCGAESQVPALTLVVQGWMRRSAEAIGEGELQAGVSDRQRTRTLVHGAMMRRA

SEQ ID NO: 711 - protein, 440 aa, Vibrio breoganii
MKIVRSDRLNINTNTHQSEALRATLNVYRKYVRDLMVLINARWRKFQHHSGNEIIAAVESLIHPTKKRPEIKHHYFHHHYYKFPSYLRRVAIMDAMGQVRSFHSRFNDWLDSGCKNRPPKLTCATATYPSLYAGQCIKFSNCGTKADIKVFKSNDWVWIAVKLNGKERFSGKKLSPLLVLKNKKWLLSVPVKMDVSLKPKVNFSGKVLSVDVGINTTATCAVVDKSGTVHGRYFLNRSDKDREYRLMNRIRAKARKQTRHGNKLPSGFCKNDHRRLKQLADNEAHQISRRIVSLARDSECDAIAVEDLKGWRPSAGKKRSTMKAKFHRWYHRMLIDRLESKAIELGIRLINVYARGTSSNAYDGSGKVKRDKGNYALCQFVTGKRYNADLNAAYNIAARGILKFFYPKVREKLWKSGKPNACPLTGSPFVLSSIWLLSQT

SEQ ID NO: 712 - protein, 376 aa, Streptomyces sp. 69
MPDAVQAPAIAATLHTVNDLANWVSDVAFTCGVPREYELRKHTYARLRAEGLGAQAAQHVIKKVRDAYTTLHANLRAGNLGKPGSKRRRKAESKPVTFRPQAAQPYDDRCLSWQYDAQTVSIWTTAGRIKGVRFTCSARALKVLQQYRKGASDLIERDGVFYLIATCEVPEAEQYEPDGWIGVDLGIVNIATTSTGYQAAGRQINRYRKRQLALRAKLQKKRTKSAKRRLKERSRREQRHVKNTNHIIAKTIVTEAERTSAGISLEELKGIRQRVRLRKPQRVALHSWAFAQLGDFIVYKARRAGVPVVFVDPAYTSQQCSECGHIDKKNRTSQALFTCRNCGVVAHADRNASRVLARRGQNAWTAGRESRVPATP

SEQ ID NO: 713 - protein, 366 aa, Salimicrobium flavidum
MATKTFLVRLKSLSKKKHKQFVCEQQTFASCVNHCVERLQSGEKLSSKNVPFDLKSAIKNEGIRKAKKAVSDVKKGLAKTVPTFRSSLGIKINNQNWNTVEKNGRWYIAFTTNEGKKTFPVVETEYVHTYFPFFTYQNREFRGTIEVLRKGRDWYVAVPVQVSSELDAEKTHKPYEAYTPVGVDLGLRHLAVLSEPVSGIRQFFSGKEVGFKRRHFRSLRRSLGKKKAQRALEHVGKKESRWMKDYNRKLAKAIVDFARQFDNPMIKMEQLDDIRKTCKSLKRADRTIHSWAFYQLKQFIREKAADYNIPVVDINPYQTSQECFLCGYAEKGNRHMDTFHCKKCGHSNHADLNASNNIATSTSLAV

SEQ ID NO: 714 - protein, 385 aa, Streptomyces sp. 69
MKIVTQVKLMPDAVQAPAIAATLHTVNDLANWVSDVAFTCGVPREYELRKHTYARLRAEGLGAQAAQHVIKKVRDAYTTLHANLRAGNLGKPGSKRRRKAESKPVTFRPQAAQPYDDRCLSWQYDAQTVSIWTTAGRIKGVRFTCSARALKVLQQYRKGASDLIERDGVFYLIATCEVPEAEQYEPDGWIGVDLGIVNIATTSTGYQAAGRQINRYRKRQLALRAKLQKKRTKSAKRRLKERSRREQRHVKNTNHIIAKTIVTEAERTSAGISLEELKGIRQRVRLRKPQRVALHSWAFAQLGDFIVYKARRAGVPVVFVDPAYTSQQCSECGHIDKKNRTSQALFTCRNCGVVAHADRNASRVLARRGQNAWTAGRESRVPATP

SEQ ID NO: 715 - protein, 360 aa, bacterium LF-3
MQLTETVKLYPNKYQIELIKVTMTEYISTVNHLVLDAINGRAITKITTADVNAILPSALCNQCIRDAKSIIRKYNKALRNSNTKVRLPVLKKMCCYINNQNFRISDDCISFPVIINGKSKRISVKTKISKRQKSIFSSSKLGTMRIVVKGHDLVAQIVYDAKEDAASSNNNVMGVDFGIKCPAVSYCPDGSVKFYGNGRKNKYIRRHYNNLRKRFQKAKKPKAVVKINNKEQRIMKDIDHKLSREIVNTAKTHDVSVIKLERLQNIRSTTRTSRKNNHSLHTWSFYRLAQFIEYKAKLAGIKVEYVDPAYTSQICPICGSVHHANDRNYTCRCGFHTHRDLLGAINICNSTEYIGNRYTA

SEQ ID NO: 716 - protein, 204 aa, Anoxybacillus pushchinoensis
MAQVAVKVVEKQNNDENIMGVDLGLKVPVVAVTSNSKTRFFGNGRQNKYIRRKYKVLRQQLGKAKQLKKIKQIGNKEQRWMKDQDHKISRQIVNFAKENHVSVIRLEKLTNIRNTARTSRKNEKNLHTWSFYRLSKYIEYKANLEGIKVEYVNPKYTSQKCPKCQTLNKANDRKYVCKCCGYRTHRDRVGALNIMKAPMADGVA

SEQ ID NO: 717 - protein, 224 aa, Bacillus mycoides
MLKHKLGTLRITKKSNKWMAQISVTLPTNERAGTKILGVDLGLKVPAVAITDDDKVRFFGNGRQNKYRKRKFRSVRKKLGKDKKVNAIRRFDDKEQRWMQEKDHKISREIIDFAIANQISVIRLEQLTNIRQTARTSRKNEKNLHTWSFYRLAQFIAYKATIAGIQIEYVNPAYTSQSCPKCAEKNKARDRKYKCPCGFKTHRDIVGAMNIRYTTVIDGNSQSA

SEQ ID NO: 718 - protein, 351 aa, Paenibacillus sp. OSY-SE
MQTVTVQIRLFPRDPAIMKEMGNEYIHTVNHLTEQAEASGAFPKVTSKDVEANLPSAVRNQAIRDARSIHNKTKKQGKRPILKRRAYYVNNQNYSFGDSNVSFPVMMNGKVQRLTVSVRITEREQRLLFSNKLGLLRVVEKSGKWYVHIAVEIPTEPLTSGATMGIDLGLKVPAVVVTSTGKTQFVGNGRQNRYMRRKFQARRRKMGKLKKLSAIRKQQNKEHRYMKDQNHKISRKIVNMAIEEQVSVIKIEKLTNIRQTTRTSRKNAKNLHTWSFYQLQMFIAYKAALAGIKVLEVNPAYTSQTCPACSKRNKADDRTYQCLCGFHTHRDRVGAINIMRQPGADGNSLSA

SEQ ID NO: 719 - protein, 390 aa, Streptomyces sp. NRRL S-146
MKLVIRVKLLPTPEQASALQATLHACNAAANHVSHTAFTTGTRRNRELRALTYTQVKTRWSLGAQAAQHVIKKTADAYAALTGNLKAGNLGKPGSKRFRKATEKPITFRPQGAQPYDDRMLSWQMPQRTVSIWTVAGRMKRLAFTGEETQLLLLAHHRQGESDLTSHNGHWYLLATVDLPESPTTPDPREFIGIDLGITNIATTSTGHRHSGRHLNRSRQNDRRNRDNLARKQTRSAKRRAKHRAGREARRTRDINHKISKHIVTEAQRTGRGIALEDLGGIRERARLKKPQRVTIHSWAFAQLGAFIAYKARRAGVPVVHVHPAYTSQECSRCHHIDKRNRPAQAVFSCRNCGFVEHADLNASHVIAGRGWWMWVCGAESQVPALTLIA

SEQ ID NO: 720 - protein, 382 aa, Methylocaldum sp. SAD2
MMRTASIRLELSAAQADALARLRASYADACNRLVPIVREYRLWNRVGLHQRTYTMLREATPLGSQMCCNAIFSVCKAYKAQKELGRIRKDAPVPGIRFDRASVHFDKRTYSLKGETVSLYTLDGRIEVPMRLGEHQRRILESGKPKEAELVFRKGKWFLNLVVESGDVEPVASGPVMGVDVGENNLAATSTGKVFGGEHLRDRRDRYLALRRRLQSNGSQSARQKLRQVSGKEARHVKHINHETSKAIVQAAIQAGVAKITMEDLTHIWERIKAGKRMRGRLHRWAWRQLQTFVEYKAKVAGIAVEYVSPAYTSQTCSCCGGLGKRSKHRFECPHCGLRAHSDCNASRNLARIGEIAVSPRAAVNTPDVGSVDMGNHVCASQ

SEQ ID NO: 721 - protein, 393 aa, Thermococcus sp. EXT12c
MPSETIKLTTKFKLKETPEGLDGLFQTYREIVNFLITYASENNITSFYRLKKETYKSLRKEYPELPSHYLYTACQMATAIFKSFRKRRKKGKAKGKPVFKREVIMLDDHLFKLDLEKGTVKLTTPSGRIQLEFYPARYHEKFKDWKVGQAWLVRTPKGTFINVVFSKEVKVSEPKAFVGVDLNENNVTLSLPNGEFVQIITHEREIRTGYFVKRRRIQGKIRAGKRRRELLEKYGLRERNRLNDLYHKLANKIVELAEKYGGIALEDLTEIRESIRYSAEMNGRLHRWSFRKLQSIIEYKAKLRGVKVVFVNPAFTSSLCPVCGGKLSPNGHRVLKCSNCGFEADRDVVGSWNIRLKALKMWGVSVPPESLTMKTGVGKVIRYDWFTSSKSSG

SEQ ID NO: 722 - protein, 389 aa, Rhodococcus jostii
MKRVVKIKLAPTDAQARALHDTLMLCDTAAGVVSRVAQASEDRRAFALQKAVYHQLKALGLSAQPAVRTIKKVADAYATRGANLEAGNYGPGGGKRATDIAATAIGFRALAAQPFDDRCLSWQQQGSTISIWTSEGRLKAVRYVCAPWQRALLEHRCGETDLVFRDNMWFLHATVDVPAPEPVEPVVVEEFLGVDLGIVNLAVTSDDTAASADWSSGAVTARRGKYTRTRRTLQKVGSKSAKRKLRRRREKEHRYATDINHQISKTIVAQAQRTGRGIVLEDLSGIRERVRPAKAQRQQLHSWAYAQLRDFVTYKAASVGVPVEVINPRNTSRTCYPCGHVDKANRITQDRFVCRVCGHVDQADHNAALNIAYLGYVKYMTTTHGYWAA

SEQ ID NO: 723 - protein, 191 aa, Halanaerobium sp.
MGIDIGLRQLAVASVKNSQGKEINRQFHNGKQAGFIRKKYRMLRRKLGQSKKVKAIKNINDKEQRWMTDLNHKISRQLVNLAVQEQVGTIIMENLENIRNTAKSLNRADRNIHNWTFYQLQQFIEYKAELAGIKVEYINPKYTSQSCSRCAKVKKSNRKANLYSCECGNHIHSDLNAGRNITNKYLEQQSA

SEQ ID NO: 724 - protein, 414 aa, bacterium LF-3
MKHMQLSETVKLYPTEYQIELIRNTMSEYISTVNNIVSDYTNKDNGNIESVKEIKNIKSISKLTTADVKAKLPSALCNQCIRDAKSIVKKYDKACKEVEKAKKNKKNKKSKKNKNSKNVKEVEEIKEVKEVKKLKEIKVPVLKKLCCYINNQNFKIQDNYISFPVMIDGKSKRISVKTKMTDKQKLILSSHRLGTMRIVIKNINILVAQFVYEINEIEKVNESNNVMGVDLGIKCPAVSYCTDGSVKFYGNGRKNKYMRRHYANLRKWFQKAKKPTVVKRIKNKEQRIMKDIDHKISREIVNTAKKHKAKVIKLERLENIRSTTRTSRKNNPSLHTWSFYRLAQYIEYKAKLAGIEVEYVDPAYTSQKCLQCGNIHHAKDRKYICKCGYHTHRDLLGAINICNSTEYIGNRCIA

SEQ ID NO: 725 - protein, 382 aa, Verrucomicrobium sp. 3C
MMRTASIKLDASPEQRAALAALQSAFANACQRLSAVVREHRVWNRVALHQRAYSEMRSSTPLGSQMCCNAIFSVCKAYKALKVTGRIPKDTPVPAISFQRASVHFDKRTYALKKNAVSLYSLGGRVIVPMRLGEHQRRILSFGRPKEAELAFRKGNWYFNLVVESDDKESIASGPVMGVDVGENNLAAHSLGGIFGGGRLCDRRDHHLALRRRLQSNGSRSAKQKLRQVSGKERRHVTHVNHETSKAIVREALEAGVSKITMEDLTHIRDRIKAGKRMRGRLHRWAFRQLQRFVEYKAKSAGIAVEYVDPAYTSQTCSSCKQLGRRTKHRFACPHCGLRAHSDLSASRNLARIGGTAVPPRAAVSTPNVGGADVGNHVCASQ

SEQ ID NO: 726 - protein, 371 aa, Nitrosococcus oceani
MKRTVSIKLVPTPEQAQALLELQSELAKACNLIVPFARDNRCWNRVALHHLAYYPVREATNLGSQMVCNALKAVADAYKVLKLKKSDDIPAIRFRETGSVHFDARTYRLKGDAVSLYTLTGRAIVKMSPGEFQAQYLAAGKPKEGKLVRRGKQWFFNLVLDWPDTASAKGSGILGIDLGENNLASTSSGKILGGGPLRHVRDRHLALRRRLQSNGRQSARQLLRKVSSKERRHMRQVNHEASKAMVEEALKQGASTIVLETLTHIRKRIKGGKRLRFRLHRWAWRELQDFIAYKAEAAGIQVIYVNPAYSSKTCSACGCLGSRIQHKFSCSSCGHLAHSDRNAAVNLAKLARSIGIARPEVAPAHVAVPTH

SEQ ID NO: 727 - protein, 321 aa, Nitrosococcus oceani AFC27
MAYYPVREATRLGSQMVCNAVKAVADAYKVLKLGRHDEIPVIRFRETGSVHFDARTYRLKGDAVSLYTLTGRAIVKMSPGEFQAQYLAAGKPKEGKLVRRGKQWFFNLVLDWPDTAPAKGSGILGIDLGENNLASTSSGKILGGGPLRHVRDRHLALRRRLQSNGRQSARQLLKKVSGKERRHMRQVNHEASKAMVGEALKQGASTIVLETLTHIRKRIKGGKRLRARLHRWAWRELQDFIAYKAEAAGIRVIYVNPAYSSKSCSACGCLGSRIQHKFSCSSCGHLAHSDRNAAVNLAKLAKSIGIARLGVAPAHVAVPTH

SEQ ID NO: 728 - protein, 388 aa, Nocardiopsis sp. JB363
MKLVVRVKLLPSPEQARALQATLRTCNEAADHASQVAQATGATNKYALQRAVYHELKARFGLSAQPTVRVLGKVCDAYTTRQANLKAGNLGRKGSPRRQRVESTPISFRPDAAQPFDDRCLSWQMDARTVSIWTVAGRMKNLGFVTSPEQLKLLTEYRQGESDLIYRDGQWFLAATCEVPEQEENPEPVGFMGVDLGIVEIATTSAGDRFSGRVLNRYRRKQNRLRAKLQRKNTKSAKRVLKRLRRREARRAREVNHQISKSIVERAERTDHGIVLEDLKGIRGRVRQAKRQRSALHSWSFAQLRDFIGYKARRVGVPVLVVDPAYTSQTCSECDHTSRRNRPTRNRFVCRQCGVVLHADVNASRNLAHRGQAVWTAGRTSTAPTPSR

SEQ ID NO: 729 - protein, 359 aa, Bacillus licheniformis
MSQTITVKVKLLLTKEQEEILNEMSHTYISVINQLVSEMVDNKKSTKKTSKHVTALLPGSVKNQAIRDSKSIFSKRVKKSNYKIIPILKKPVCVWNNQNYSFDFTHIHLPLTIDGKTKRTPIRALLVDKHNRNFDLLKHKLGTLRITKKSNKWIAQISVNISLIEKTGTKVMGVDLGLKVPAVAVTDDGKTRFFGNGRQNKYVRRKFKSKRKQLGKLKKLNVIRKLEDKEQRYMKDQDHKISRAIVNFAIDHNISVIRLEQLTNIRQTARTSLKNEKNLHNWSFYRLSQFIEYKANLEGIKVEYVNPAYTSQTCPKCSEKNKAQDRKYKCKCGFEKHRDLVGAMNIRYAPVVDGNSQPA

SEQ ID NO: 730 - protein, 126 aa, bacterium LF-3
MKDIDHKLSREIINTAKAHDVSVIKLERLQNIRSTTRTSRKNNHSLHTWSFYRLAQFIEYKAKLAGIKVEYVDPAYTSQICPICGRIQHAKDRNYICRCGYHTHRDLLGAINICNSTEYIGNRYTA

SEQ ID NO: 731 - protein, 384 aa, Nocardiopsis sp. JB363
MRVKLLPSPEQARALQATLRTCNEAADHASQVAQATGATNKYALQRAVYHELKARFGLSAQPTVRVLGKVCDAYTTRQANLKAGNLGRKGSPRRQRVESTPISFRPDAAQPFDDRCLSWQMDARTVSIWTVAGRMKNLGFVTSPEQLKLLTEYRQGESDLIYRDGQWFLAATCEVPEQEENPEPVGFMGVDLGIVEIATTSAGDRFSGRVLNRYRRKQNRLRAKLQRKNTKSAKRVLKRLRRREARRAREVNHQISKSIVERAERTDHGIVLEDLKGIRGRVRQAKRQRSALHSWSFAQLRDFIGYKARRVGVPVLVVDPAYTSQTCSECDHTSRRNRPTRNRFVCRQCGVVLHADVNASRNLAHRGQAVWTAGRTSTAPTPSR

SEQ ID NO: 732 - protein, 359 aa, Bacillus mycoides
MSQTLTVKVKLIPTKEQIRLLEQSSHEYIKVINTLVSEMVEAKKSTKKSTKDIEANIPSAVKNQAIKDAKSLFVTKVKKSKYKIIPILKKPVCVWNNQNYSFDSNYISVPLMINGKSTRLKVRALLIDKNNRNLDLLTHKLGTLRITKKSDKWSAQISVTLPRSEKAGTKILGVDLGLKVPAVAITDNDKIRFFGNGRQNKYRKRKFRSARKKLGRDKKVNAIRRFNDKEQRWMQDKDHKISREIIDFAIENHISVIRLEKLTNIRQTARTSRKNEKNLHTWSFYRLSQFIAYKATLAGIKIEYVDPAYTSQSCPKCAEKNKAQDRKYKCSCGFETHRDIVGAMNIRYATVIDGNSQSA

SEQ ID NO: 733 - protein, 358 aa, Bacillus sp. FJAT-46582
MSQTITVKIKLLPTKEQDLTLTEMSKTYISTINDLVSEMVKEKKSTKKTSKNIGASLPSAVKNQAIKDAKSVFKKAKKTKFETIPVLKKPTCIWNNQNYSLDFTHISLPIMIDGKAKKTPIRALLIDKENRNFNLLKHKLGTLRITKKSNKWIAQISVTTPTPQKTGFKVMGVDLGLKVPAVAVTDDGKVRFFGNGRQNKYKKRKFRSVRKALGKKKKLNAIRSSKNKEQRWMKDQDHKVSRAIVNFAKENEISVIRLEQLANIRQTTRTSRKNEKNLHTWSFYRLSQFIEYKAKLEGIKVEYVNPVYTSQTCPNCSEKNKAQDRKYKCKCGFEKHRDLVGAMNIRCAPVIDGNSQSA

SEQ ID NO: 734 - protein, 358 aa, Bacillus sp. FJAT-46582
MSQTITVKIKLLPTKEQDLTLTEMSKTYISTINDLVSEMVKEKKSTKKTSKNIGASLPSAVKNQAIKDAKSVFKKAKKTKFETIPVLKKPTCIWNNQNYSLDFTHISLPIMIDGKAKKTPIRALLIDKENRNFNLLKHKLGTLRITKKSNKWIAQISVTTPTPQKTGFKVMGVDLGLKVPAVAVTDDGKVRFFGNGRQNKYKKRKFRSVRKALGKKKKLNAIRSSKNKEQRWMKDQDHKVSRAIVNFAKENEISVIRLEQLANIRQTTRTSRKNEKNLHTWSFYRLSQFIEYKAKLEGIKVEYVSPVYTSQTCPNCSEKNKAQDRKYKCKCGFEKHRDLVGAMNIRCAPVIDGNSQSA

SEQ ID NO: 735 - protein, 380 aa, Ectothiorhodospira sp. PHS-1
MMRTASIRLEVSAEQASALAALRTAYADACNRLVPIVREYRLWNWVGLHQRTYSNLREATPLGSQMCCNVIFSVCKAYKAQKELGRIRKDEPIPEIRFDRLSVHFDKRTYTLKNDAVTLYTLDGRIKVAMRPGEHQRRILTSGQPKEAELVLRKGQWFFNLVVESGDAEPVASGPVMGVDVGENTLAAHSLGKVFGGDPLRDKRDRYLALRRRLQSNGSQSAKQKLRQVSGKEARRVKHINHETSKAIVQTAIQAGVAKITMEDLTHIRSRIKAGKRMRGRLHRWAWRQLQSFVEYKAKAAGIAVEYVNPAYTSQTCSDCGSIGKRSKHRFVCEHCGLRAHSDLNASRNLARIGSGAPLSRAAVNTPDVGNGINHALVSQ

SEQ ID NO: 736 - protein, 400 aa, Thermoproteus tenax
MRGCSPMTSVVLTVVGKVIEPNKGKTLELNRALEEYLKLVRWYVGFGITSKTKLHELTYEEAKKRFSLNTALIQTARDKAVEILKSFSERKAEGRAKADRPAVKRVSIRLDRRAFKLDKSSTKLTPYWLVVSLRRGVRIALPLAFGSRQKQFIEETLQGLWELDSVELVKRDGVWFAHFKIKKNVVTYGAEEAKTLIGVDLGEWNAVAAAAISRDSPSRPMRGQFWGGQRIRFVRGKYAHIRRSLQRKKRLDLVKRIGSKEGRTVNQMLHEIAKGVVEYAKQFPKPVIVMEDLEGIRDRMSGDNKLLNRRLHSWSFRKLQKYIEYKALLSGIPIVYVKPKNTSRTCHRCGFTVDEVKGREFRCPRCGLRYNRDLNAAINIALALTRGRGWGAVTPPRTPT

SEQ ID NO: 737 - protein, 354 aa, Paenibacillus sp. FSL R7-0333
MQSVTIKIRFFPNNSIELKSLSNEYIRVINLLTEQAEQAEQAGAFPKLTTKHVAATLPSAVINQAIRDAKSIFKKVKKDRKRPILKKPTYYINNQNYSIRDSSIAFPIIINNIVKKTVFPAVLTERDKKYLQYAKCGLMRIVEKSGKWFAQVSLEVPTEITTGEHVMGVDLGLKFPAVAVTSGGKTGFFGNARENKYRKRKFRSERKVLGKKKKLHAIRRLDNKEQRWMKDRDHKASRQIINFATKNQVSVIHLEKLTNIRKTTRTSRKNEKNLHTWSFYRLSQFIEYKANMAGIKVEYVDPAYTSQKCPSCSALNKATDRKYSCLCGFHTHRDKVGAMNIIHAPVIGGNSRSA

SEQ ID NO: 738 - protein, 358 aa, Bacillaceae
MSQTITVQVKLLPTKEQASILSEMSQSYISTINTLVSEMVAEKKSTKKSSKNISAALPSAVKNQAIKDAKSVFKKAKKNKYKVIPVLKKPVCIWNNQNYSFDLTHILMPIMVNGKATKTPIRALLVDKDNRNFDLLKHKLGTLRVTKKTNKWIAQISVTIPPIQGTDLKVMGIDLGLKVPAVAVTDDEKVRFFGNGRQNKYVKRKFRSERKTLGKRKKLNAIRNSKDKEQRWMKDQDHKVSRAIIDFAKENKISVIRLEKLANIRQTASTSRKNEKNLHNWSFYRLAKFIEYKANLEGMKVEYVNPAYTSQTCPKCFEKNKAQDRKYKCKCGFEKHRDLVGAMNIRYAPVIDGNSHSA

SEQ ID NO: 739 - protein, 376 aa, Streptomyces sp. CdTB01
MPEAEQAAALSATLRAVNDLACWVSDVAFAHGVPREYELRKRTYPRLKAEGLGAQAAQHTIKKVRDAYTALRANVRAGNLGKEGSKRRRKAESKPITFRPEAAQPYDDRCLSWKYDQQTVSIWTTEGRLKGVRFVCSASALKVLQQYRKGESDLIERDGVFYLIATCEVPEAEPYEPGGFIGVDLGIVNIATTSTGYQAAGRRLNRYRKRQLALRAKLQKKRTKSAKRRLKERSRREQRHAKNTNHIIAKTIVTEAERTSAGISLEELKGIRQRVRLRKPQRVALHSWAFAQLGEFIVYKAKRAGVPLVFVDPAYSSRECAECGHIDRLNRISQATFVCRSCGIVAHADRNASHVLGRRGEDAWTAGRESRVPAIP

SEQ ID NO: 740 - protein, 126 aa, uncultured Clostridium sp.
MKDIDHKLSREIINTAKAHDVSVIKLERLQNIRSTTRTSRKNNHSLHTWSFYRLATFIEYKAKLAGIKVEYVDPAYTSQICPICGSVHHANDRNYTCRCGFHTHRDLLGAINICNSTEYIGNRYTA

SEQ ID NO: 741 - protein, 256 aa, Halorubrum distributum
VRTVWTGEKWELHFVCKVEVEVAEAPGEKAVGVDLGINNFAALAYEDGHSELYPLNCLKQDDYYFSKRIARCDDSNSEQATRLNQKKSARRTHYFHTLSKHIVERCVDEGVGTIVVGNLSGIREDDDSDESRNWGKHGNLDLHSWAFDRFTDLLEYKAEMEGITVEEVSEEDTSKSCSCCGRKRDANRVERGLYVCDECGTVANADVNGAENIRQKVSPSPATDGGDRSNGWLAQPSTFLFDKETGAFAPQERATS

SEQ ID NO: 742 - protein, 376 aa, Halobacillus hunanensis
MGGENMATKTILVKLKHVTKKKHKQFMEEQAVYASCVNHCVERLLNGEKLSSKDVSFPLKSAIKNEGIRRAKKAVSDFKKGIAKTIPVFRNSLNIKINNQNWNTVDKNGRWYIAFTSNQGKKALPVVETKDVQSYFPFLTSHTREFRGTVELFRKGRRWYVAIPIQVSSDLDLGNNHPSVTKPLTDYTSIGVDLGLRHLVVLSEPTSGKRQFFSGKEVGYKRRHFRSLRRSLGKKKAQRAMERVGQKESRWMKDYNRKLAQDIVTFAQQFERPMIKLEQLENIRKTCRSMKRADKTIHSWAFYQLKQCIKERAATFNIPVVDIDPYQTSQTCFACKHAERSNRNREAFHCKNCGHKAHADLNASRNIATSTNLAAS

SEQ ID NO: 743 - protein, 389 aa, Thermococcus celer
MPNETIKLTAKFKLKNPPNGLDNLIQTYREIVNTLITHAHENNITSFYRLKKETYKSLRKEYPELPSHYLYTACQMATAIYKSYRKRNKKGKAKGKPAFKKEVIMLDDHLFKLDLDRKIIKLSTPNGRISLEFYPAKYHEKFRGWKVGQAWLVKTPKGVFVNVVFSTEVEAQEPKSFVGVDLNENNVTLSLPNGEFVQIITHEREVRTGYYVKRRRIQRKLKAGKKRKKLLEKYGEREKNRLNDLYHKVANKIVELAEEYGGIALEDLTNIRESIRYSAEMNGRLHRWSFRKLQSIIEYKAKLRGVSVVFVDPAYTSSRCPVCGGKLSPNGYRGVKCECGFEADRDVVGSWNIRLRALKMWGVSVPPESHSMKMGGWKVGRNDVYKSYG

SEQ ID NO: 744 - protein, 358 aa, Bacillus thermoamylovorans
MSQTVTVKIKLLPTKEQALTLTEMSKTYISTINDLVSEMVKEKKNTKKTSKNIDVSLPSAVKNQAIKDAKSVFKKAKKTKFETVPVLKKPMCIWNNQNYSFDFTHIYLPIMIDGKAKKTPIRALLVDKDNRNFNLLKQKLGTLRITKKSNKWVAQISVTIPTVKKTGVKVMGVDLGLKIPAVAVTDDEKVRFFGNGRENKYKKRKFRSVRKALGKKKKLNAIRNSKNKEQRWMKDKDHKISRAIVNFAKENKVSVIRLERLANIRQTTRTSRKNEKNLHTWSFYRLSQFIEYKANLEGIEVEYVNPAYTSQTCPRCSEKNKAQDRKYKCKCGFEKHRDIVGAMNIRYAPVVDGNSQPA

SEQ ID NO: 745 - protein, 126 aa, uncultured Clostridium sp.
MKDIDHKLSREIVNTAKAHDVSVIKLEQLQNIRSTTRTSRKNNHSLHTWSFYRLATFIEYKAKLAGIEVEYVDPAYTSQICPICGSVHHANDRNYTCRCGFHTHRDLLGAINICNSTEYIGNRYTA

SEQ ID NO: 746 - protein, 358 aa, Gracilibacillus timonensis
MSQTITIKVKLIPTKEQASILSEMSKTYISVINTLVSEMVDEKKSTKKSSKDISVSLPSAVKNQAIKDAKSVFKKGKKSKYKVIPILKKTVCVWNNQNYSFDSTHISMPIMMDGKAKKIPIRALFMDKDNRNMDLLKHKLGTLRITKKANKWMAQISVTIPTVQGTGLKVMGVDLGLKVPAVAVTDDEKVRFFGNGRQNKYVKRKFRSERKALGKRKKLNAIRNSKDKEQRWMKDQDHQVSRAIVNFAKDHRVSVIRLEQLANIRQTARTSRKNEKNLHSWSFYRLSQFMEYKANLEGIKVEYVNPAYTSQTCPTCFEKNKAQDRKYTCKCGFKKHRDLVGAMNIRYAPVIDGNSQSA

SEQ ID NO: 747 - protein, 388 aa, Streptomycetaceae bacterium MP113-05
MPGMKIVTQVKLIPEADQAAALSATLRTVNDLACWVSEVAFAHGVPREYELRKYTYPRLKAEGLGAQAAQHVIKKVRDAYTTLHANIRAGNLGKSKSKRRVKAGSRPITFRSEAAQPYDDRCLSWQYDAQTVSIWTTAGRLKSVRFVCSADALKTLREYRKGEADLIECDGVFYLIATCEVPEAETYEPDCFIGVDLGIVNIATTSTAYQAAGRGLSRYRKRQVALRAKLQKKCTKSAKRRLKERSRREARHVKNTNHIIAKTIVTEAERTSAGISLEELKGIRQRVRLRKPQRVALHSWAFAQLGDFIVYKAKRAGVPLVFVDPAYTSQTCAECGHVDKRNRVDQGLFICRGCGVVAHADRNASHNIATRGETVWNAGRESRVPATP

SEQ ID NO: 748 - protein, 253 aa, Verrucomicrobium sp. 3C
  misc_feature (105)..(105): Xaa can be any naturally occurring amino acid
MRLGEHQRRILSSGRPKEAELVFRKGNWYFNLVVESDDKESIASGPVMGVDVGENNLAAHSLGGIFGGGRLCDRRDRHLALRRRLQSNGSRSAKQKLRQVSGKEXRHVTHVNHETSKAIVREALEAGVAKIMMEDLTHIRDRIKAGKRMRGRLHRWTFRQLQRFVEYKAKSAGIAVEYVDPAYTSQTCSSCKQLGRRTKHRFACPHCGLRAHSDLNASRNLARIGGTMVPPRAAVSTPNVGGADVGNHVCASR

SEQ ID NO: 749 - protein, 353 aa, Paenibacillus sp. PDC88
MQPITVKIRFFPKDISGLKELSKEYIRIVNTLTERAEIEGSFPKVTTKNIEAALPSAVLNQVIRDAKSVFRITKKRKKRPVLKKPTYCINNQNYSLDQSSLAFPIMVNGKAKKTIFPALITERDKKILQAAKLGLMRVVEKSGKWFAQISLEVPTPSQKPTKEQLMGIDLGLKVPAVAVTNEGKTKFFGNGRENKFMKRKFRKTRKCLGEKKKLSTLRKLHDKEQRWMKDKDHKISREIVNFAVDNQVSIIRLEQLTNIRKTTRTSRKNEKNLHTWSFYRLAQFIEYKANMVGIKVEYVDPAYTSQKCPTCDSKNKVKDRKYACSCGYKTHRDRVGAINIIHAPVIGGNSQSA

SEQ ID NO: 750 - protein, 408 aa, uncultured Clostridium sp.
MQLSETVKLYPTEYQIELTRNTMSEYISTVNNIVSDYTNKDNGNIESVKEIKNIKSISKLTTADVKAKLPSALCNQCIRDAKSIVKKYDKACKEVEKAKKNKKNQKSKKNKNSKNVKEVEEIKEVKKLKEIKVPVLKKLCCYINNQNFKIQDNYISFPVMIDGKSKRISVKTKMTDKQKLILSSHRLGTMRIVIKNINTLVAQFVYEINEIEKVNESNNVMGVDLGIKCPAVSYCTDGSVKFYGNGRKNKYMRRHYANLRKWFQKAKKPTVVKRIKNKEQRIMKDIDHKISREIVNTAKKHKAKVIKLERLENIRSTTRTSRKNNPSLHTWSFYRLAQYIEYKAKLAGIEVEYVYPAYTSQKCPQCGNIHHAKDRKYICKCGYHTHRDLLGAINICNSTEYIGNRCIA

SEQ ID NO: 751 - protein, 358 aa, Gracilibacillus timonensis
MSQTITIKIKLIPTKEQASILSEMSKTYISVINTLVSEMVDEKKSTKKSSKDISVSLPSAVKNQAIKDAKSVFKKGKKSKYKVIPILKKTVCVWNNQNYSFDSTHISMPIMMDGKAKKIPIRALFMDKDNRNMDLLKHKLGTLRITKKANKWMAQISVTIPTVQGTGLKVMGVDLGLKVPAVAVTDDEKVRFFGNGRQNKYVKRKFRSERKALGKRKKLNAIRNSKDKEQRWMKDQDHQVSRAIVNFAKDHRVSVIRLEQLANIRQTARTSRKNEKNLHSWSFYRLSQFMEYKANLEGIKVEYVNPAYTSQTCPTCFEKNKAQDRKYTCKCGFKKHRDLVGAMNIRYAPVIDGNSQSA

SEQ ID NO: 752 - protein, 358 aa, Bacillus cereus
MYQAVTVKIKLLLTKEQASILNAMGKEYISTINALVSEMVAEKKTTKKTTKDVPVNLPSAVKNQAIKDAKSVFQKVKKGKCEIIPVSKKPICVWNNQNYSFDFTHISLPLTIEGKTKRVSVRALLIDKHNRNFDLLKHKLGTLRITKKSNKWIAQISVTIPTAEKIGTKIMGVDLGLKVPAVAVTDDEKTRFFGNGRQNKYVRRMFKSKRKKLGESKKLSAIRNFDDKEQRYMKDQDHKISRAIVNFAKENKISVIRLEQLANIRQTTRTSRKNEKNLHTWSFYRLSQFIEYKANLEGIKVEYVNPAYTSQTCPNCSKKNKAQDRKYKCKCGFEKHRDLVGAMNIRYAPVIDGNSQSA

SEQ ID NO: 753 - protein, 391 aa, Thermococcus zilligii
MPSETVKLTAKFKLKETPEELDDLFSTYREIVNFLITYAFENKITSFYRLKKETYGGLRKKYSKLPSHYLYTACQMATAIFKSYRKRKKKGKAKGKPVFMKDVVMLDDHLFKLDLEAGVVKLSAPSGRVQLEFYSAKYHERFKDWRIGQAWLVRSKKGVFLNVVFSKDVEIREPEAFVGVDLNENNVTLSLPDWKFVQIITHEREVRTGYFVKRRRIQKKLRAGRKKEKLLEKYGERERNRLNDLYHKLANKIVELAGKYGGIALEDLAEIRNSIRYSAEMNGRLHRWSFRKLQSIIEYKAKLKGLRVVFVDPAFTSSLCPVCGGKLSPNGDRVLKCGCGFEGDRDVVGSWNIRLRGLKMWGVTVPPESQPMSRGWKVSRNDIYELYKSYG

SEQ ID NO: 754 - protein, 358 aa, Bacillus cereus
MYQAVTVKIKLLLTKEQASILNAMGKEYISTINALVSEMVAEKKTTKKTTKDVPVNLPSAVKNQAIKDAKSVFQKVKKGKCEIIPVSKKPICVWNNQNYSFDFTHISLPLTIEGKTKRVSVRALVIDKHNRNLDLLKHKLGTLRITKKSNKWIAQISVTIPTTEKTGTKIMGVDLGLKVPAVAVTDDEKTRFFGNGRQNKYVRRMFKSKRKKLGESKKLSAIRNFDDKEQRYMKDQDHKISRAIVNFAKENKISVIRLEQLANIRQTTRTSRKNEKNLHTWSFYRLSQFIEYKANLEGIKVEYVNPAYTSQTCPNCSKKNKAQDRKYKCKCGFEKHRDLVGAMNIRYAPVIDGNSQSA

SEQ ID NO: 755 - protein, 358 aa, Terrabacteria group
MSQTITVKIKLIPTKEQASILSEMSKTYISTINDLVSDMVKEKKSTKKSSKHMDVPLPSAVKNQAIKDAKSVFKKVKKSKYEVVPVLKKPMCIWNNQNYSFDLTHISMPIVVNGKVKKTPIRALLVDKDNRSIDLLKHKLGTLRITKKSNKWIAQISVTVPTTQGTGLKVMGVDLGLKVPAVAVTDDEKVRFFGNGRQNKYKRRKFRSERKTLGKKKKLDAIRSSKDKEQRWMKEQDHKVSRAIINFAKENKISVIRLEKLANIRQTTRTSRKNEENLHTWSFYRLAQFMEYKANLAGIRVEYVNPAYTSQICPKCSEKNKVQDRKYKCKCGFEKHRDLVGAMNIRSAPVVDGNSQSA

SEQ ID NO: 756 - protein, 211 aa, Duodenibacillus massiliensis
  misc_feature (10)..(10): Xaa can be any naturally occurring amino acid
MRFFLWRFSXSGEEHLKNLKADEIMGIDVGENNIAAVSTGRIWKAGALKDKRDRYMSQRKRLQRNGSQSARQHLKKASGRERRHVTHVNNVVSKEIVQEAAKRGIKLIALEDLTHIRDHIKAGKRIRSRLHRWSFRELQEMIVYKAAAAGIRCVFLDPRYTSQTCSQCGAPGKRHKHGFRCSQCGHLAHSDLNASRNLQGLCRQLSAQGLM

SEQ ID NO: 757 - protein, 359 aa, Bacillus mycoides
MSQTLTVKVKLIPTKEQSRLLEESSREYIKVMNMLVSEMVEAKKSTKKSTKDIEANIPSAVKNQAIKDAKSLFATKVKKSNYKIIPILKKPVCVWNNQNYSFDSTHISIPFKVNGKSTRLKVRVLLINKKNRNLDLLKHKLGTLRITKKSNKWMAQISVTLPTNERAGTKILGVDLGLKVPAVAITDDDKVRFFGNGRQNKYRKRKFRSVRKKLGKDKKVNAIRRFDDKEQRWMQEKDHKISREIIDFAIANQISVIRLEQLTNIRQTARTSRKNEKNLHTWSFYRLAQFIAYKATIAGIQIEYVNPAYTSQSCPKCAEKNKARDRKYKCPCGFKTHRDIVGAMNIRYATVIDGNSQSA

SEQ ID NO: 758 - protein, 358 aa, Bacillus sp. FJAT-46582
MSQTITVKIKLLPTKEQDLTLTEMSKTYISTINDLVSEMVKEKKSTKKTSKNIGASLPSAVKNQAIKDAKSVFKKAKKTKLETIPVLKKPTCIWNNQNYSLDFTHISLPIMIDGKAKKTPIRALLIDKENRNFNLLKHKLGTLRITKKSNKWIAQISVTTPTPQKTGFKVMGVDLGLKVPAVAVTDDGKVRFFGNGRQNKYKKRKFRSVRKALGKKKKLNAIRSSKNKEQRWMKDQDHKVSRAIVNFAKENEISVIRIEQLANIRQTTRTSRKNEKNLHTWSFYRLSQFIEYKAKLEGIKVEYVNPVYTSQTCPHCSEKNKAQDRKYKCKCGFEKHRDLVGAMNIRCAPVIDGNSQSA

SEQ ID NO: 759 - protein, 117 aa, Paramaledivibacter caminithermalis DSM 15212
VNHKISKEIVNIAKEEKAIINLEELKNIRERIKYSKKMNKRLHNWNFYQLQTFIEYKANAEGLEVVYVKPNYTSQMCSACEHIDKRNRPNQSTFKCKACGYEANADYNTSVNIANVL

SEQ ID NO: 760 - protein, 358 aa, Bacillus sp. FJAT-46582
MSQTITVKIKLLPTKEQDLTLTEMSKTYISTINDLVSEMVKEKKSTKKTSKNIGASLPSAVKNQAIKDAKSVFKKAKKTKLETIPVLKKPTCIWNNQNYSLDFTHISLPIMIDGKAKKTPIRALLIDKENRNFNLLKHKLGTLRITKKSNKWIAQISVTTPTPQKTGFKVMGVDLGLKVPAVAVTDDGKVRFFGNGRQNKYKKRKFRSVRKALGKKKKLNAIRSSKNKEQRWMKDQDHKVSRAIVNFAKENEISVIRIEQLANIRQTTRTSRKNEKNLHTWSFYRLSQFIEYKAKLEGIKVEYVNPVYTSQTCPNCSEKNKAQDRKYKCKCGFEKHRDLVGAMNIRCAPVIDGNSQSA

SEQ ID NO: 761 - protein, 242 aa, Escherichia coli
MIFTKIIRGFIRAELVFRKGLWFFNLVVEITDTTMVVSEKTMGVDMGENNLAAHSLGKLFGGEQLRDERDRHLALRRRLQSNGSQSAKQKLRQVSGKEMRRVKQTNHETSKVIVAAAAEAGIGTIILEDLTHIRDRIKAGKRVRSRLHRWAWRQLQTFIEYKARAVGIMVKYVNPAYSSQSCSCCGCLGKRHKHRFECPHCGFRAHSDLNASRNLAWIGETAVLPRASVNTPDVGSPSLAPQ

SEQ ID NO: 762 - protein, 390 aa, Streptomyces sp. Ag82_G6-1
MKLVIRVKLLPTPEQASALQATLHACNAAANHVSHTAFTTGTKRNRELRALTYTQLKTRWSLGAQAAQHVIKKTADAYTALTGNLNAGNLGKPGSKRFRRATEKPITFRPEGAQPYDDRMLSWQMPQRTVSIWTVAGRMKRLAFTGQETQLLLLAHHRQGESDLINHNGHWYLLATVDLPENPTTPDPRGFIGIDLGITNIATTSTGHRHSGRRLNRSRQNDRRNRDNLAKKQTRSATRRAKRRAGREARRTRDINHKISKHIVTEAQRTGRGIALEDLGGIRERARLKKPQRVTIHSWAFAQLGAFIAYKARRAGVPVVHVHPAYTSQECSRCHHIDKRNRPTQAVFSCRNCGFVEHADLNASHVIADRGWWTWVCGAESQVPALTLIA

SEQ ID NO: 763 - protein, 274 aa, Ktedonobacter racemifer
MFKPVRCPRSQHCAVRYNVHTSTLDWQTQTVRLSTTQGKMSLAFTVPHFSERYRGCRITTADLLCCNGTWWLHVVVDVPEPVVQPHPEVIGVDLGLNRPAVTSTRHFLGTRRWKEIDRRIFRLKRKLQSNGSKSTKRHLKKLARKQMRFHRDCDHVLSKRLVQQAPPGSTIVLENLTNLREGVRHRKGEGQRRLHTWSFAQLYGFIAYKAQERGIVVERVDPRHTSQTCSRCGHQARNNRRSQSVFHCRACGYQLHADLNAAIVRRFGAYQISL

SEQ ID NO: 764 - protein, 445 aa, Natrinema versiforme
MAKQVVTRTYTAFIRNQSRVSDDLDSLGFAASKLWNVGRWTISRVWDELDYIPEHDELTAYLKSHERYDDLHSQSSQRVLQELAEAFNGWYSKRRNGDTRANPPGYRKHGDEHPRSTVTFKNKGFKLDTQYNRVRLSKGSNLKEYWSDFILCEYQTRPDIDLSTVESVQQVRAVWTGDEWELHFVCKVEVEVAESPGEKTVGVDLGINNFAALAYEDGHSELYPLNCLKQDNYYFSKRIARCDDSNSEQATRLNQKKSRRRTHYFHALSKHIVQRCVEEGVGTIVVGDLSGIREDEENGESKNWGKHGNLDLHSWAFDRFTDLLEYKAEMEGISVEDVPERGTSKSCSCCSRERKANRVERGLYVCDECGLVANADVNGAENIRQKVSPSPVTDGVDETLCVSSAHQNAKRSEDGDRSNGWLAQPSTFLFDKETGAFAPQERVTS

SEQ ID NO: 765 - protein, 208 aa, Methanosarcina sp. MTP4
MGVDVGINYLAVASTTDKKCEFFAGGELKNLRNTYKKMRARLQSKGTLSAKRVMKRLSGKEKRLMKDVNHCISKKIVEFALENNVSVIGLEDLTGIRDRTQYRVRKKQRYTHSSWAFRQLQTFIEYKAKQVGILVEYINPEYTSQTCSRCNHISKNNRKGLRFRCGACGFEMNADLNAARNIEHRTRDFRYSVESQGCLSTIHTNKMI

SEQ ID NO: 766 - protein, 358 aa, Bacillus cereus
MYQAVTVKIKLLPTKEQASILNAMGKEYISTINALVSEMVAEKKTTKKTTKDVPVNLPSAVKNQTIKDAKSVFQKVKKAKYKIIPVLKKPICVWNNQNYSFDFTYIRLPLMIEGKTKKVSVRALLIDKHNRNFDLLKHKLGTLRITKKSNKWIAQISVTIPTAEKIGTKIMGVDLGLKVPAVAVTDDEKTRFFGNGRQNKYVRRMFKSKRKKLGESKKLSAIRNFDDKEQRYMKDQDHKISRAIVNFAKENKISVIRLEQLANIRQTTRTSRKNEKNLHTWSFYRLSQFIEYKANLEGIKVEYVNPAYTSQTCPNCSKKNKAQDRKYKCKCGFEKHRDLVGAMNIRYAPVIDGNSQSA

SEQ ID NO: 767 - protein, 268 aa, Exiguobacterium sp. KKBO11
VCVWNNQNYSFDFESISFPVWMDGKSVKMRFRAAMVDKDNRNTRLLANKLGTLRVTKKGRKWIAQISVHVPTVPRTGVRVMGVDLGLKVPAVAVTDDDTTRFFGNGRKNKYMKRKFRAERKELGKKKKPKAIKRRNQKEQRWMRDKDHKVSRAIVDFARQKKISVIRLELLANIRQTARTSRKNNQNLHSWSFYRLASFIEYKAALSGIKVEYVNPAYTSQTCPSCSVRNKVRDRVYTCACGFKGHRDAVGAMNIRYAPVMDGNSPSA

SEQ ID NO: 768 - protein, 376 aa, Streptomyces chartreusis
MPEAEQVAALLATLRTVNEAANWVSTVAFEQGVPREYELRKHTYAELKSRGLGAQAAQHTIKKVRDAYTTLKANIKAGNLGKPGSKRRKKAESTPIAFRPAAAQPYDDRCLSWQYDAQTVSIWTTAGRIRGMRFICSADGLKMLRQHRQGESDLVERNGVFYLIATCEVPEEKSYEPDGFIGVDLGIVNIATTSTGYQAAGRDLNRHRKRHGDLRTKLQRKGTKSAKRLLKKRNRRERRHVSNTNHIIAKTIVTEAERTSAGIALEDLGGIRQRVRLRKPQRVTLHSWAFAQLGESIAYKARRAGVPVVHVNPAYTSQMCCECGHVDKKNRVDQDLFTCRNCGVVAHADRNASHNIAQRGAVVWNAGRESRVPDTP

SEQ ID NO: 769 - protein, 376 aa, Streptomyces sp. St140
MPKADQAAALRSTLRTVNEAANWVSGVAFERGVPREYELRKHTYAELKAQGLGAQAAQHVIKKTRDAYTTLKANIKAGNLGKPASKRRRKAESKPIVFRPEAAQPYDDRCLSWQYDQQTVSIWTTAGRLRGVRFACSPDALRMLREHRKGESDLIERDGAFYLIAVCDIPEPEVYEPAGFVGVDLGIVNIATASTGYRAAGRGLNRHRKRQLDLRKKLQAKGTKSAKRLLKKRSRKEARHTANVNHIISKTIVTTAERTGSGIALEDLTGIRSRVRLRKDQRTSLHSWSFHQLGQYIEYKAKRAGVPLVYVDPAYTSQQCSECGHIDRKNRVDQATFACRSCGALMHADDNASHNIGRKAKTVWTAGRESRVPAIP

SEQ ID NO: 770 - protein, 351 aa, Paenibacillus sp. FSL R7-0333
MQTVTIQIRIFPTRPSVLVDMGNEYIRTVNELTEQAERSGTFPKLTSKTIHANLPSAVKNQVIRDAKSLFQRFKKTKKRPLLQKRVYYVNNQNYTIWGNHISFPVILDGKVQRFVVPVLLPDRERDMLSNGKPGLLRVVQKSAKWFVQISIERPTEPAEGHEVMGIDLGLKVPAVVVTSSGKTKFCGNGRKNKFVRRKYSTYRRKLGKLKKLSAIRKQNDKESRYMKDQNHKISRQIVNMAIQEQVSVIKLEKLTDIRKTTRTSRKNAKNLHHWSFYQLQMFIGYKATLAGIQVVEVNPAYTSQTCPSCGERNKAKDRTYQCDCGYTAHRDRVGAINIMRQPVADGNSLPA

SEQ ID NO: 771 - protein, 358 aa, Bacillus mycoides
MYQTVTVKIKLLPTKEQASILNAMGKEYISTINALVSEMVAEKKTTKKTTKDVPVNLPSAVKNQAIKDAKSVFQKVKKVKCKIIPVLKKTICLWNNQNYSFDFTYIRLPLMIDGKTKKVSVRALLIDKHNRNFDLLKHKLGTLRITKKSNKWIAQISVTIPTAEKTGTKIMGVDLGLKVPAVAVTDDEKTRFFGNGRQNKYVRRMFKSKRKKLGESKKLNAMRNFDDKEQRYMKDQDHKISRAIVNFAKENKISVIRLEQLVNIRQTTRTSRKNEKNLHTWSFYRLSQFIEYKANLEGIKVEYVNPAYTSQTCPNCSKKNKAQDRKYKCKCGFEKHRDLVGAMNIRYAPVIDGNSQSA

SEQ ID NO: 772 - protein, 426 aa, Haloquadratum walsbyi
MAKQVVTRTYIASIRNQSQVQDDLDSLGFAASKLWNVGRWTCSRIWDEIDHIPNHNELTTYLKTHERYDDLHSQSSQRVLQELAEAFNGWYGKRRNGDTNANPPGYRKHGDDHPRSTVTFKAAGFKLDTQYYRVRLSKGSNLKDYWSDFILCEYQTRPDVDLSTVENVQQVRIVWTGTEWELHFVCKVQIDVAEAPSENTVGVDLGINNFAALAYEDGHGELYPLNCLKQDDYYFSKRIARCDDSNSEQATRLNHKKSARRTHYFHTLSKHIVERCVEEGVGTIVVGDLSGIREDDDTNKSKNWGKHGNLDLHSWAFDRFTDLLEYKAEMEGITVEEASEEDTSKSCSCCGRKRDANRVERGLYVCDDCGTVANADVNGAENIRQKVSLSSLNLSVNRSNGWLAQPSTFLFDKETGAFAPEERVRS

SEQ ID NO: 773 - protein, 358 aa, Bacillus caseinilyticus
MSQTITVKIKLLPTKEQASVLQNMSQSYISTINTLVTEMVAEKKSTKKSSKDISALLPSAVKNQAIKDAKSVFKKVKKNKYKVIPVLKKPVCIWNNQNYSFDFTHISMPIMINGKATKTPIRALLVDKDNRNFDLLKHKLGTLRITRKANKWIAQISVTIPTTQGTGLKVRGVDLGLKVPAVAVKDDDRLCFFGNGRQNKYIKRKYRSERKALGKKKKLNAIRSSKEKEQRWMKDQDHKISRAIVNFAKDKKISVIRLEQLAYIRQTTRSSRKNEKNLHNWSFYRLSQFIEYKANLVGIKVEYVNPAYTSQTCPKCSEKNKALDGKYKCKCGFEKHRDLVGAMNIRYAPVVDGNSQPA

SEQ ID NO: 774 - protein, 371 aa, Nitrosococcus oceani
MKRTVSIKLVPTPEQAQALLELQSELAKACNLIVPFARDNRCWNRVALHHLAYYPVREATRLGSQMVCNAVKAVADAYKVLKLGRHDEIPVIRFRETGSVHFDARTYRLKGDAVSLYTLTGRAIVKMSPGEFQAQYLAAGKPKEGKLVRRGKQWFFNLVLDWPDTAPAKGSGILGIDLGENNLASTSSGKILGGGPLRHVRDRHLALRRRLQSNGRQSARQLLKKVSGKERRHMRQVNHEASKAMVGEALKQGASTIVLETLTHIRKRIKGGKRLRARLHRWAWRELQDFIAYKAEAAGIRVIYVNPAYSSKSCSACGCLGSRIQHKFSCSSCGHLAHSDRNAAVNLAKLAKSIGIARLGVAPAHVAVPTH

SEQ ID NO: 775 - protein, 393 aa, Thermococcus piezophilus
MPSVTVKLTAKFKLKTIPEGLDGLFSTYREIVNFLITYAFENNVTSFYRLKKETYRELREKYSQLPSHYLYTACQMATSIFKSYRKRKRKGKANGKPIFKKEVIMLDDHLFKLDLEKGLIKLSTPNGRIQLEFYPAKYHEKFGDWKVGQAWLVRTPKGVFLHVVFSRAVEVREPKAFIGVDLNENNVTLSLPNGEFLQIITHEREIRTGYFLKRRKIQRKIRAGKKRKELLEKYGQREKNRLNDLYHKIANKIVELAEEYCGIALEDLSEIRDSIRYSAEMNGRLHRWSFCKLQSIIEYKAKLKGIKVVFVNPAFTSSLCPICGGRLSPNGCRVLHCENCGFESDRDVVGSWNIRLRALKMWGVSAPPERQPMKMGGWKVTHYDSFICSKSSG

SEQ ID NO: 776 - protein, 413 aa, Duodenibacillus massiliensis
MSVQKRSKATSKGLNTSADGVRRVEGSGKCVRTACVRLELLDPAAHEKLVATQRLYAQVCNFVVPTVAADRTKRLWQRFTLHHAVYDKIKAKFPDLGSQYACNVIRSVSAAYKTELANHPAQLKSKDKKLKTLVFRHPSVHVDKNTLTFFPDGTVSISTISGRIRARLFPGPFQKELLASGKRKECNLVLHPRRGRKEAFWELHIAVESQGCSGEEHLKNLKADEIMGIDVGENNIAAVSTGRIWKAGALKDKRDRYMSQRKRLQRNGSQSARQHLKKASGRERRHVTHVNNVVSKEIVQEAAKRGIKLIALEDLTHIRDHIKAGKRIRSRLHRWSFRELQEMIVYKAAAAGIRCVFLDPRYTSQTCSQCGAPGKRHKHGFRCSQCGHLAHSDLNASRNLQGLCRQLSAQGLM

SEQ ID NO: 777 - protein, 358 aa, Bacillus cereus group
MYQTVTVKIKLLPTKEQASILNAMGKEYISTINALVSEMVAEKKTTKKTTKDVPVNLPSAVKNQAIKDAKSVFQKVKKGKCKIIPVLKKTICVWNNQNYSFDFTYIRLPLMIDGKTKKVSVRALLIDKHNRNFDLLKHKLGTLRITKKSNKWIAQISVTIPTAEKTGTKIMGVDLGLKVPAVAVTDDEKTRFFGNGRQNKYVRRMFKSKRKKLGESKKLNAIRNFDDKEQRYMKDQDHKISRAIVNFAKENKISVIRLEQLVNIRQTTRTSRKNEKNLHTWSFYRLSQFIEYKANLEGIKVEYVNPAYTSQTCPNCSKKNKAQDRKYKCKCGFEKHRDLVGAMNIRYAPVIDGNSQSA

SEQ ID NO: 778 - protein, 413 aa, Duodenibacillus massiliensis
MSVQKRSKATSKGLNTSADGVRRVEGSGKCVRTACVRLELLDPAAHEKLAATQRLYAQVCNFVVPTVAADRTKRLWQRFTLHHAVYDKIKAKFPDLGSQYACNVIRSVSAAYKTELANHPAQLKSEDKKLKTLVFRHPSVHVDKNTLTFFPDGTVSISTISGRIRARLCPGPFQKELLASGKRKECNLVLHPRRGRKEAFWELHIAVESQGCSGKEHLKNLKADEIMGIDVGENNIAAVSTGRIWKAGALKDKRDRYMSQRKRLQRNGSQSARQHLKKASGRERRHVTHVNNVVSKEIVQEAAKRGIKLIALEDLTHIRDHIKAGKRIRSRLHRWSFRELQEMIVYKAAAAGIRCVFLDPRYTSQTCSQCGAPGKRHKHGFRCSQCGHLAHSDLNASRNLQGLCRQLSAQGLM

SEQ ID NO: 779 - protein, 413 aa, Duodenibacillus massiliensis
MSVQKRSKATSKGLNTSADGVRRVEGSGKCVRTACVRLELLDPAAHEKLAATQRLYAQVCNFVVPTVAADRTKRLWQRFTLHHAVYDKIKAKFPDLGSQYACNVIRSVSAAYKTELAKHPAQLKSEDKKLKTLVFRHPSVHVDKNTLTFFPDGTVSISTISGRIRARLCPGPFQKELLASGKRKECNLVLHPRRGRKEAFWELHIAVETQGCSGEEHLKNLKADEIMGIDVGENNIAAVSTGRIWKAGALKDKRDRYMSQRKRLQRNGSQSARQHLKKASGRERRHVTHVNNVVSKEIVQEAAKRGIKLIALEDLTHIRDHIKAGKRIRSRLHRWSFRELQEMIVYKAAAAGIRCVFLDPRYTSQTCSQCGAPGKRHKHGFRCSQCGHLAHSDLNASRNLQGLCRQLSAQGLM

SEQ ID NO: 780 - protein, 413 aa, Duodenibacillus massiliensis
MSVQKRSKATSKGLNTSADGVRRVEGSGKCVRTACVRLELLDPAAHEKLAATQRLYAQVCNFVVPTVAADRTKRLWQRFTLHHAVYDKIKAKFPDLGSQYACNVIRSVSAAYKTELAKHPAQLKSEDKKLKTLVFRHPSVHVDKNTLTFFPDGTVSISTISGRIRARLCPGPFQKELLASGKRKECNLVLHPRRGRKEAFWELHIAVESQGCSGEEHLKNLKADEIMGIDVGENNIAAVSTGRIWKAGALKDKRDRYMSQRKRLQRNGSQSARQHLKKASGRERRHVTHVNNVVSKEIVQEAAKRGIKLIALEDLTHIRDHIKAGKRIRSRLHRWSFRELQEMIVYKAAAAGIRCVFLDPRYTSQTCSQCGAPGKRHKHGFRCSQCGHLAHSDLNASRNLQGLCRQLSAQGLM

SEQ ID NO: 781 - protein, 235 aa, Halobiforma haloterrestris
MSEAPGEKTVGVDPGINNFAALAYEDGHAELYPLNCLKQDDYYFSKRIARCDDSDSEQATRLDQKKSRRRTHYFHTLSKHIVQRCVDEGVGTIVVGDLSGIREDDENGEAKDWGKHGNLDLHSWAFDRFTDLLEYKAEMEGITVEEVSERDTSKSCSCCGRKRDANRVERGLYVCDECDMVANADVNGAENIRQKVSPSPATDGGDRSNGWLAQPSTFLFDKETGAFAPQEPVTS

SEQ ID NO: 782 - protein, 385 aa, Streptomyces roseochromogenus
MKIVTQVKLMPEADQAAALLATLRTVNDLACWVSEVAFAQGVPREYELRKHTYPRLKAEGLGAQAAQHCIKKVRDAYTTLHANIRAGNLGKPKSKRRIKAESKPITFRPDAAQPYDDRCLSWQYDTQTVSIWTTAGRIKNVRFACSADALKTLREYRKGESDLIERDGDFYLIATCEVPEAETYEPDGFIGVDLGIVNIATTSTDHQAAGRGLNRYRKRQLALRAKLQKKRTKSAKRRLKERSRREQRHVKNTNHIIAKTIATEAERTSAGISLEELKGIRQRVRLRKPQRVALHSWAFAQLGDFIVYKAKRAGVPLVFVDPAYSSRECAECGHIDRLNRISQAKFACRSCGVVAHADRNASHVLARRGETVWNAGRESRVPATP

SEQ ID NO: 783 - protein, 359 aa, Bacillus cereus
MSQTLTVKVKLIPTKEQSRLLEESSREYIKVMNMLVSEMVEAKKSTKKSTKDIEANIPSAVKNQAIKDAKSLFATKVKKSNYKIIPILKKPVCVWNNQNYSFDSTHISIPFKVNGKSTRLKVRALLINKKNRNLDLLKHKLGTLRITKKSNKWMAQISVTLPTNERAGTKVLGVDLGLKVPAVAITDDDKVRFFGNGRQNKYRKRKFRSVRKKLGKDKKVNAIRRFDDKEQRWMQEKDHKISREIIDFAIANQISVIRLEQLTNIRQTARTSRKNEKNLHTWSFYRLAQFIAYKATIAGIQIEYVNPAYTSQSCPKCAEKNKARDRKYKCPCGFKTHRDIVGAMNIRYTTVIDGNSQSA

SEQ ID NO: 784 - protein, 362 aa, Paenibacillus sp. FSL R7-0333
MVKNKKRGGETLQTVTIQIRIFPTRPSVLVDMGNEYIRTVNELTEQAERSGTFPKLTSKTIHANLPSAVKNQVIRDAKSLFQRFKKTKKRPLLQKRVYYVNNQNYTIWGNHISFPVILDGKVQRFVVPVLLPDRERDMLSNGKPGLLRVVQKSAKWFVQISIERPTEPAEGHEVMGIDLGLKVPAVVVTSSGKTKFCGNGRKNKFVRRKYSTYRRKLGKLKKLSAIRKQNDKESRYMKDQNHKISRQIVNMAIQEQVSVIKLEKLTDIRKTTRTSRKNAKNLHHWSFYQLQMFIGYKATLAGIQVVEVNPAYTSQTCPSCGERNKAKDRTYQCDCGYTAHRDRVGAINIMRQPVADGNSLPA

SEQ ID NO: 785 - protein, 386 aa, Peptococcaceae bacterium CEB3
MKQTDEEKGQVITIKLKLFNSTKTKQDMYQTMADRTTDFANRYLGLDKPMRPKSSGDAKLHSEPLPAAVLCQAIRDIEAKKNAKSFKRLWPDFNNQNFRIEKETMQDGGAAWKVSFPTLEKRVGVPIQAEKYQVKYLELLLSGQAKQGTAQLIKCGRQWYIHLALTVSVKAEKKPPKYMGVDLGLIDLAVASILGSTLFFSGAELAYIRRHYAELRKKLQKKGAHKALRKLGNKEHRWIMAINHTISRRIIEFAKAHGVSVIRLEDLRGARWTKSQRKKQRKDAGRSLHSWAFFQLRQFIEYKAALAGIEVELVNPELTSLTCSRCGEVRTSRPAGRWYTCPRCGKVKHIDANAADNIAQAISGLSEEKRAKTILKPKTRRRTTAA

SEQ ID NO: 786 - protein, 267 aa, Halococcus sediminicola
MGTLHYREDEDAFYLHIVVMKEVEQREGVRVLGVDLNLKNVAVTSTGTFYDGGRLLWGQNHHFRVRRSLQDKDTRSAKQTLQQVSGRENRFVLDRLHTLSRRLVDEARNYNCAFIAVERLTNIRDRLDNGNDCIKRQMHNWAFRELREMLAYKAAEHGIRVEDVNPAFTSQTCSRCGHQSSTNRDSSTGWFSCNECGTEYDGDYNAAKNIGMRLVTLPSGKRPDGLGNGQLALKSGTLNGSGDYTAHDDVSADQESTDKPTTSVVGR

SEQ ID NO: 787 - protein, 413 aa, Duodenibacillus massiliensis
MSVQKRSKATSKGLNTSADGVRRVEGSGKCVRTACVRLELLDPAAHEKLAATQRLYAQVCNYVVPTVAADRTKRLWQRFTLHHAVYDKIKAKFPDLGSQYACNVIRSVSAAYKTELAKHPAQLKSEDKKLKTLVFRHPSVHVDKNTLTFFPDGTVSISTISGRIRARLCPGPFQKELLASGKRKECNLVLHPRRGRKEAFWELHIAVESQGCSGEEHLKNLKADEIMGIDVGENNIAAVSTGRIWKAGALKDKRDRYMSQRKRLQRNGSQSARQHLKKASGRERRHVTHVNNVVSKEIVQEAAKRGIKLIALEDLTHIRDHIKAGKRIRSRLHRWSFRELQEMIVYKAAAAGIRCVFLDPRYTSQTCSQCGAPGKRHKHGFRCSQCGHLAHSDLNASRNLQGLCRQLSAQGLM

SEQ ID NO: 788 - protein, 249 aa, uncultured Clostridium sp.
MIDGKSKRISVKTKMTDKQKLILSSHRLGTMRIVIKNINTLVAQFVYEINEIEKVNESNNVMGVDLGIKCPAVSYCTDGSVKFYGNGRKNKYMRRHYANLRKWFQKAKKPTVVKRIKNKEQRIMKDIDHKISREIVNTAKKHKAKVIKLERLENIRSTTRTSCKNNPSLHTWSFYRLAQYIEYKAKLVGIEVEYVDPAYTSQKCPQCGNIHHAKDRKYICKCGYHTHRDLLGAINICNSTEYIGNRCIA

SEQ ID NO: 789 - protein, 386 aa, Rhodococcus opacus
MKRVVKIKLAPTDAQAHALHETLVLCNTAADVVSRVAQAVEDRRAFALQKAVYHQLKALGLSAQPAVRTIKKVADAYATRGANLEAGNYGPRGGKRATDIAATAIGFRALAAQPFDDRCLSWQQQDSTVSIWTCEGRLKAVRYVCAPWQRELLEHRCGETDLVFRDNMWFLYATVDVPTPEPVVVQEFLGVDLGIVNLAVTSDDTAASADWSGGAVTARRTKYARTRRALQKVGSKSAKRKLRGRREKEHRYATDINHQISKTIVAQAQRTGRGIVLEDLSGIRERVRLAKTQRQQLHSWAYAQLRDFVTYKAVSVGVPLVVIDPRNTSRTCYPCGHVDKANRTTQDRFVCRMCGHVDQADHNAALNIAYLGYVQYTTTTRSHRAV

SEQ ID NO: 790 - protein, 195 aa, Methanotorris formicicus Mc-S-70
MSKVKEKGPYKQTLWFGVDLGVYNLVVIADNKGESLRFDGEIVKGHKRRLKKKEFNKYTKVGNKISNYSRYINHVISKEIVKKAKQYNAGIVLEKLKGLKKSKLNNSTPKNIRRVLHIWSYADLIEKIEYKANLEGVPVVEVSPRNTSKTCSRCGYVNRRLKNERIFICSKCGLEIDRDLNAAINIAKKVASKQV

SEQ ID NO: 791 - protein, 392 aa, Thermococcus barophilus
MPSETIKLTAKFKLKEAPESLDYLFSTYRKIVNFLIIHAFENNITSFYRLKKETYKGLRKEYPELPSHYLYTACQMATAIFKSFRKRKKKGKANGRPVFKKEVIMLDDHLFKLNLEAGVVKLLTLKGRILLEFYPAKYHEKFKDWKVGQAWLVRMPKGVFLNVVFSKEVEVSEPKAFVGVDLNENNVTLSLPNGEFVQIITHEREIRAGYFVKRRKIQQKIRAGRKRRELLEKYGERKRNRLNDLYHKLANKIVELAEKYGGLALEDLTEIRDSIRYSAEMNGRLHRWSFRKLQSIIEYKAKLKGVRVVFVNPAFTSSLCPVCGGKLSPNGHRVLSCKCGFEADRDVVGSWNIRLRALKMWGVPVPPESQPMKTGGWKVSRNDIYKLYKSYG

SEQ ID NO: 792 - protein, 358 aa, Exiguobacterium sp. ZWU0009
MSQVVTVEVRIYATRRQDAILKRMGKTYIQTANRVVANMVASEDGKRWSSKDIDTPLPSAVKNQLAGDAVGIYKKARKEDFKRIPVLKKPVCVWNNQNYSFDFESISFPVWMDGKSVKMRFRAAMVDKDNRNTRLLANKLGTLRVTKKGRKWIAQISVHVPTVPRTGVRLMGVDLGLKVPAVAVTDDDTTRFFGNGRKNKYMKRKFRAERKALGKKKKPKAIKRRNQKEQRWMRDKDHKVSRAIVDFARQKKISVIRLELLANIRQTARTSRKNNQNLHSWSFYRLASFIEYKAALSGIKVEYVNPAYTSQTCPSCSVRNKVRDRVYTCACGFKGHRDAVGAMNIRYAPMMDGNSPSA

SEQ ID NO: 793 - protein, 358 aa, Bacillus cereus group
MYQTVTVKIKLLPTKEQASILNAMGKEYISTINALVSEMVAEKKTTKKTTKDVPVNLPSAVKNQAIKDAKSVFQKVKKAKCKIIPVLKKPICVWNNQNYSFDFTYIRLPLMIDGKTKKVSVRALLIDKHNRNFDLLKHKLGTLRITKKSNKWIAQISVTIPTAEKTGTKIMGVDLGLKVPAVAVTDDEKTRFFGNGRQNKYVRRMFKSKRKKLGESKKLNAIRNFDDKEQRYMKDQDHKISRAIVNFAKENKISVIRLEQLVNIRQTTRTSRKNENNLHTWSFYRLSQFIEYKANLEGIKVEYVNPAYTSQTCPNCSKKNKAQDRKYKCKCGFEKHRDLVGAMNIRYAPVIDGNSQSA

SEQ ID NO: 794 - protein, 425 aa, Thermococcus guaymasensis DSM 11113
MSSETIKLTAKFKLKETPEGLGALFQTYREIVNFLITHAFENTVTSFYRLKKETYKSLRQEYPELPSHYLYTACQMATAIFKSFRKRKKKGKAKGKPVFKREVIMLDDHLFKLDLENKTVKLSTPNRRIQLEFYPAKYHEKFKDWKVGQAWLVKTPKGVFLNVVFSREVEVEELKAFVGVDLNENNVTLSLPNGEFVQIITHEREVRTGYFLKRRKIQRKIRAGKRRRGLLEKYGRREKNRLNDLCHKLANKIVELAEKYGGIALEDLAEIRDSIRYSAEMNGRLHRWSFRKLQSIIEYKAKLRGVRVVFVNPAFTSSLCPVCGEKLSPNGHRVLKCSNCGFEADRDVVGSWNVRLRALKMWGVTVPPESPPMKTGVGKVIRYDWFTSSKSSGQPERWANLDAAFPSAPQVPQRVPQSTDRARSP

SEQ ID NO: 795 - protein, 358 aa, Exiguobacterium sp. ZWU0009
MSQVVTVEVRIYATRRQDAILKRMGKTYIQTANRVVANMVASEDGKRWSSKDIDTPLPSAVKNQLAGDAVGIYKKARKEDFKRIPVLKKPVCVWNNQNYSFDFESISFPVWMDGKSVKMRFRAAMVDKDNRNTRLLANKLGTLRVTKKGRKWIAQISVHVPTVPRTGVRLMGVDLGLKVPAVAVTDDDTTRFFGNGRKNKYMKRKFRAERKALGKKKKPKAIKRRNQKEQRWMRDKDHKVSRAIVDFARQKKISVIRLELLANIRQTARTSRKNNQNLHSWSFYRLASFIEYKAALSGIKVEYVNPAYTSQTCPSCSVRNKVRDRVYTCACGFKGHRDTVGAMNIRYAPVMDGNSPSA

SEQ ID NO: 796 - protein, 212 aa, Methanotorris formicicus
MLFFIYNKKEGNDYYAYLSKVKEKGPYKQTLWFGVDLGVYNLVVIADNKGESLRFDGEIVKGHKRRLKKKEFNKYTKVGNKISNYSRYINHVISKEIVKKAKQYNAGIVLEKLKGLKKSKLNNSTPKNIRRVLHIWSYADLIEKIEYKANLEGVPVVEVSPRNTSKTCSRCGYVNRRLKNERIFICSKCGLEIDRDLNAAINIAKKVASKQV

SEQ ID NO: 797 - protein, 396 aa, Peptococcaceae bacterium CEB3
MRRLFFMWRGGENVEENTEQVVTIKLKLFEPTKTKQDMYQTMADRTTDFANRYLGVEKPMRPKSSADAKLYTEPLPAIVLNQAIRDIEAKKNAKSFKRLWPDFNNQNFRVEKETLQDGGAAWKVSFPTLEKRVGVPIQVEKYQIKYLELLLSGQAKQGTAQLIKCGRQWYIHLALTVSVKAEKKPPKYMGVDLGLIDLAVASILGSTLFFSGAELAYVRRHYAELRKKLQKKGAHKALRKLGNKEHRWIMAINHTISRRIIEFAKAHGVSVIRLEDLRGARWTKSQRKKQRKDAGRSLHSWAFFQLRQFIEYKAALAGIEVELVNPELTSLTCSRCGEVRTSRPAGRWYTCPRCGKVKHIDANAADNIAQAISGLSEEKRAKTILKPKTRRRTTAA

SEQ ID NO: 798 - protein, 166 aa, Nitrosococcus watsonii
MQSKGTRGARRVLKRLSGRESRHIRHENHLLSKALVDEAQMHQCGTIRLEKLTGIRARTKVRNKHLNRMVNGWSFGELQKFVEYKATRAGIKTEHVNPAYTSKTCSCCGKRGSRQQDVFRCATCGESHSDINAAANIAGGGVCKPSRINADCEINFSHDVVESCLL

SEQ ID NO: 799 - protein, 130 aa, Rhodococcus opacus PD630
MAGGSRSALRGRAGTARGIVLEDLSGIRERVRLAKAQRQQLHSWAYAQLRDFVTYKAASVGVPVEVINPRNTSRTCYPCGHVDKANRITQDRFVCRVCGHVDQADHNAALNIGYLGYVKYMTTTHGYWAA

SEQ ID NO: 800 - protein, 339 aa, Trichococcus palustris
MKTVQIKLKPTKTQALELKRLSLEYIWQANVLVQQAISEEGFPKVTSKDIEADIPSVLKNELIRYAKSKLKQFGKCVFKKPMLSYNNQNFSVDEKAIRFPLMVEGKAKKTAIKAIIPEEVFALLSGSKLGALRITKKGFHWMAQISVHTEAEEFLGDGILGVDLGILCPAVGVVASNGKTQFFGNGRQNKCLRRKYKELRRQLGKKKKLNAIRNINDKESRIMRDINHKLSRQIVTFAVEKNCGTIHLEKLSGIRRTSRLRGKNKANLHSWTFHELSSFIEYKARELGIKVVYINPEYTSQICPMCGERNKVKDRNYNCGCGYHSHRDRVGALNIARTI

SEQ ID NO: 801 - protein, 358 aa, Exiguobacterium
MSQVVTVEVRIYATRRQDAILKRMGKTYIQTANRVVANMVASEDGKRWSSKDIDTPLPSAVKNQLAGDAVGIYKKARKEDFKRIPVLKKPVCVWNNQNYSFDFESISFPVWMDGKSVKMRFRAAMVDKDNRNTGLLANKLGTLRVTKKGRKWIAQISVHVPTVPRTGVRVMGVDLGLKVPAVAVTDDDTTRFFGNGRKNKYMKRKFRAERKALGKKKKPKAIKRRNQKEQRWMRDKDHKVSRAIVDFARQKKISVIRLELLANIRQTARTSRKNNQNLHSWSFYRLASFIEYKAALSGIKVEYANPAYTSQTCPSCSVRNKVRDRVYTCACGFKGHRDAVGAMNIRYAPVMDGNSPSA

SEQ ID NO: 802 - protein, 351 aa, Paenibacillus chondroitinus
MQTLTIQIRIFPSNPSVLVDMGNEYIRTVNELTEQTEASGTFPKLTSKTVNANLPSAVKNQLIRDAKSIFQKSKKEKKRPILKKRVYYVNNQNYAIGDDSVSFPVVMDGKVQRLVVPAVIADREKTMLSNSKHGILRVVQKSAKWFVQVSIERPTEQAEGDVVMGIDLGLKVPAVVVTSSGKTKFVGNGRKNKYIRRMYNDNRRKLGKLKKLSAIRKQRDKESRYMKDQNHKISRQIVNMAIKENVSVIKLEKLADIRKTTRTSRKNAKNLHNWSFYQLQMFIAYKAAIAGIKVVEVNPSYTSQTCPSCGQRNKAKDRTYQCTCGYTAHRDRVGAINIMRQPVADGNSLSA

SEQ ID NO: 803 - protein, 53 aa, Scytonema sp. HK-05
MFLVSTLQELQTVVLELLVPIFQIKQMCEALKNDPRFIGQPRRFYTSTGSTNA

SEQ ID NO: 804 - protein, 385 aa, Streptomyces mirabilis
MKIVVQVKLVPDAAQASAVGATLHTVNDRANWVSGVAFARGVPREYELRKHTYAELKAAGLGAQAAQHTIKKVVDAYTTLRANLRAGNLGKLGSKRRKKAESKPVAFRPEAAHPFDDRCLSWQYDAQTVSIWTTAGRLKNVRFACSPDALKTLREYRKGESDLIERDGVFYLIAVCEVPEAEQYEPGQFIGVDLGIANIATTSTGYRAAGRGLNRHRKRQLDLRKKLQAKGTKSARRRLKNRRRKEARHAGHVNHIIAKQIVTEAERTSSGIALEDLGGIRQRVRLRKPQRVTLHSWAFHQLGQFVEYKARRAGVPLVYVDPAYTSQECAECPHIEKKNRVDQALFICRKCGVVAHADRNASHNIAARGEAVWIAGRESRVPAPF

SEQ ID NO: 805 - protein, 342 aa, Trichococcus palustris
MSKMKTVQIKLKPTKTQALELKRLSLEYIWQANVLVQQAISEEGFPKVTSKDIEADIPSVLKNELIRYAKSKLKQFGKCVFKKPMLSYNNQNFSVDEKAIRFPLMVEGKAKKTAIKAIIPEEVFALLSGSKLGALRITKKGFHWMAQISVHTEAEEFLGDGILGVDLGILCPAVGVVASNGKTQFFGNGRQNKCLRRKYKELRRQLGKKKKLNAIRNINDKESRIMRDINHKLSRQIVTFAVEKNCGTIHLEKLSGIRRTSRLRGKNKANLHSWTFHELSSFIEYKARELGIKVVYINPEYTSQICPMCGERNKVKDRNYNCGCGYHSHRDRVGALNIARTI

SEQ ID NO: 806 - protein, 358 aa, Bacillus mycoides
MYQTVAVKIKLLPTKEQASILNAMGKEYISTINALVSEMVAEKKTTKKTTKDVPVNLPSAVKNQAIKDAKSVFQKVKKVKCEIIPVLKKTICLWNNQNYSFDFTYIRLPLMIDGKTKKVSVRALLIDKHNRNFDLLKHKLGTLRITKKSNKWIAQISVTIPTAEKTGTKIMGVDLGLKVPAVAVTDDEKTRFFGNGRQNKYVRRMFKSKRKKLGESKKLNAMRNFDDKEQRYMKDQDHKISRAIVNFAKENKISVIRLEQLVNIRQTTRTSRKNEKNLHTWSFYRLSQFIEYKANLEGIKVEYVNPAYTSQTCPNCSKKNKAQDRKYKCKCGFEKHRDLVGAMNIRYAPVIDGNSQSA

SEQ ID NO: 807 - protein, 358 aa, Bacillus cereus group
MYQTVTVKIKLLPTKEQASILNAMGKEYISTINALVSEMVAEKKTTKKTTKDVPVNLPSAVKNQAIKDAKSVFQKVKKVKCEIIPVLKKTICLWNNQNYSFDFTYIRLPLMIDGKTKKVSVRALLIDKHNRNFDLLKHKLGTLRITKKSNKWIAQISVTIPTAEKTGTKIMGVDLGLKVPAVAVTDDEKTRFFGNGRQNKYVRRMFKSKRKKLGESKKLNAMRNFDDKEQRYMKDQDHKISRAIVNFAKENKISVIRLEQLVNIRQTTRTSRKNEKNLHTWSFYRLSQFIEYKANLEGIKVEYVNPAYTSQTCPNCSKKNKAQDRKYKCKCGFEKHRDLVGAMNIRYAPVIDGNSQSA

SEQ ID NO: 808 - protein, 358 aa, Caryophanon latum
MGQTIMINIKLLPTKEQATILEEMSKSYITAINELVAEMVHAKQLLKKTSKNVFVPLPSAVKNQLIQDAKSVFNKAKKTNYHCIPVLKKPLCVWNNQNYSFDFTHISLPIMVNGKAKKTPIRALLVDRENRNFTLLNHKLGTLRITKKNHKWIAQISVTIPTIQKAGMRIMGVDLGLKVPAVAVTDDEHVRFFGNGRQNKYMKRKFRSKRKELGQKKKLKAIRTLNNKEQRWMKDQDHKVSRAIVEFAKEQKISVIRLEKLANIRQTARTSRKNEKNLHTWSFYRLANFIEYKANLVGIKVEYVNPAYTSQTCPQCGEKNKAQDRNYKCKCGFKKHRDLVGAMNIRYAPVVDGNSPSA

SEQ ID NO: 809 - protein, 388 aa, Nocardiopsis synnemataformans
MKATVQIKLLPSPEQAEALSATLHACNQAANSASQVAFATGATHKFALQKRIYEHLKVEYGLSAQPTVRVIGKVADAYTTRASNLRAGNLGPPGSQRRKKATSGPVSFTQDSAQPFDNRCLSWQLDARTVSIWTVRGRMKQVPFTGSTDQLKTVAEHRRGESDLAYRDGMWFLHATCDIPEEPLNVNPEGFVGVDLGIVNIATTSDGHRHAGRGLNRHRRRMNQLRAKLQRKRTKSTKRGLKRVRRREARRARDVNHQISKQIVERAERTGRGIALEDLQGIRERVRQAKAQRAALHSWAFAQLRNFITYKARRAGVPVAVVDPAYSSQSCSECDHTSRRNRTAQARFVCLSCGVIMHADANASRNLAHRGEVAWNAGRLSAAPTPLP

SEQ ID NO: 810 - protein, 349 aa, Microtetraspora glauca
MAFAKGLKRRNVLQKEVYFALKADYDLGAQPAVRVVKKVCDAYATLKGNINAGNLGREGSKRRLRAESKPIRFREDAAQPFDDRILTWNLDARTVSIWTVAGRIKHIPFVCSSETLKLLASRKGESDLVMRDGMFFLIATIHVPEPDVSEPDGFLGVDLGIVNIATTSDGQIMSGRRLNHYRRRMLNLRSKLQKKRTKSAKRALKRIRRRESRHAANANHIIANRLVATAERTSRGIALEDLSGIRQRVTAKKDQRARLHSWAFAQLGGFVEYKARRAGVPVVFVDPRNTSRQCSECWHTHRTNRVDQARFVCRSCGTVMHADHNGSRNIAHRGEAAWKRGAVNRPRTA

SEQ ID NO: 811 - protein, 229 aa, uncultured Clostridium sp.
MKCKSNNNVIYSYKYHVVFCPKYRRPVLVDGVVDAFSNDNVMGVDLGIKCPAVSYCPDGSVKFYGNGRKNKYIRRHYNNLRKRFQKAKKPKAVVKINNKEQRIMKDIDHKLSREIVNTAKAHDVSVIKLERLQNIRSATRTSRKNNHSLHTWSFYRLATFIEYKAKLAGIEVEYVDPAYTSQICPICGSVHHANDRNYTCRCGFHTHRDLLGAINICNSTEYIGNRYTA

SEQ ID NO: 812 - protein, 393 aa, Thermococcus sibiricus MM 739
MPSETIKLASKFKLKETPEGLNELFSTYRDIVNFLITHAFENNITSFYRLKKEIYKSLRKEYPELPSHYIYTACQMAASIYKSYRKRKRRGKASGRPVFKKEAIMLDDHLFKLDLEKGIIKLSTPNGRITLKFYPAKHHEKFKNWKVGQAWLVRTPKGVFINVVFSKEVEVKEPEDFVGVDLNENNVTLSLSDGEFVQIITHEKEIRTGYFVKRRKIQKKVKVGKKRQELLEKYGERERNRLNDLYHKLANKIVELAEKYGGIALEDLTEIRNSIRYSAEMNGRLHRWSFRKLQSIIEYKAKLKGVEVVFVDPAYTSSLCPVCGEKLSPNGHRVLKCLNCGFEADRDVVGSWNVRLRALKMWGVSVPPESPPMKMGGGKASRGDVYELYTNYG

SEQ ID NO: 813 - protein, 383 aa, Peptococcaceae bacterium CEB3
MEENTEQVVTIKLKLFEPTKTKQDMYQTMADRTTDFANRYLGVEKPMRPKSSADAKLYTEPLPAIVLNQAIRDIEAKKNAKSFKRLWPDFNNQNFRVEKETLQDGGAAWKVSFPTLEKRVGVPIQVEKYQIKYLELLLSGQAKQGTAQLIKCGRQWYIHLALTVSVKAEKKPPKYMGVDLGLIDLAVASILGSTLFFSGAELAYVRRHYAELRKKLQKKGAHKALRKLGNKEHRWIMAINHTISRRIIEFAKAHGVSVIRLEDLRGARWTKSQRKKQRKDAGRSLHSWAFFQLRQFIEYKAALAGIEVELVNPELTSLTCSRCGEVRTSRPAGRWYTCPRCGKVKHIDANAADNIAQAISGLSEEKRAKTILKPKTRRRTTAA

SEQ ID NO: 814 - protein, 351 aa, Paenibacillus sp. FSL R7-269
MQSVTIKIRFFPNNSIELKSLSKEYIRVINLLTEQAEQEGAFPKLTTKHVEATLPSAVINQAIRDAKSIFKKVKKDRKRPILKKPTYYINNQNYSIRDSSIAFPIITNNIVKKTVFPAVLTERHKKYLQHAKCGLMRIVEKSGKWFAQVSLEVPTEIATGEHVMGVDLGLKVPAVAVTSGGKTGFFGNGRENKYRKRKFRSERKVLGKKKKLHAIRRLDNKEQRWMKDKDHKASRQIINFATKNQVSVIHLEKLTNIRKTTRTSRKNEKNLHTWSFYRLSQFIEYKANIAGIKVEYVDPAYTSQKCPSCSALNKATDRKYSCLCGFQTHRDKVGAVNIIHAPVIGGSSQSA

SEQ ID NO: 815 - protein, 386 aa, Rhodococcus jostii
MKRVVKINLAPTDAQAHALHETLVLCNTAADVVSRVAQAVEDRRAFALQKAVYHQLKALGLSAQPAVRTIKKVADAYATRGANLEAGNYGPRGGKRTTDIAATAIGFRALAAQPFDDRCLSWQQQDSTVSIWTCEGRLKAVRYVCAPWQRELLEHRCGETDLVFRDNMWFLYATVDVPTPEPVVVQEFLGVDLGIVNLAVTSDDTAASADWSGGAVTARRTKYARTRRALQKVGSKSAKRKLRGRREKEHRYATDINHQISKTIVAQAQRTGRGIVLEDLSGIRERVRLAKTQRQQLHSWAYAQLRDFLTYKAVSVGVPLVVIDPRNTSRTCYPCGHVDKANRTTQDRFVCRMCGHVDQADHNAALNIAYLGYVQYTTTTRSHRAV

SEQ ID NO: 816 - protein, 391 aa, Bacillus cereus BAG6O-2
MQSLWTRSYFVSTAKNVANENMLKIKKQGVKRMSQTLTVKVKLIPTKEQSRLLEESSREYIKVMNMLVSEMVEAKKSTKKSTKDIEANIPSAVKNQAIKDAKSLFATKVKKSNYKIIPILKKPVCVWNNQNYSFDSTHISIPFKVNGKSTRLKVRALLINKKNRNLDLLKHKLGTLRITKKSNKWMAQISVTLPTNERAGTKVLGVDLGLKVPAVAITDDDKVRFFGNGRQNKYRKRKFRSVRKKLGKDKKVNAIRRFDDKEQRWMQEKDHKISREIIDFAIANQISVIRLEQLTNIRQTARTSRKNEKNLHTWSFYRLAQFIAYKATIAGIQIEYVNPAYTSQSCPKCAEKNKARDRKYKCPCGFKTHRDIVGAMNIRYTTVIDGNSQSA

SEQ ID NO: 817 - protein, 418 aa, Thermotoga naphthophila
MARGAQNMTKHMKTYKFPAPPEYHTKCKELSKLAGRVYSKTVSLVRKIHRKKNVWLSEGTVKKYISQWAQNIPLHSQTKQALVERYFEALKSYFKASKTNPALRPPFRTPKYTNVVWKNQAVKLLEDGTLRLAMANKEEPLYIPTTLPKKVDIRRVELVYDKRQDKYFFHVTVSFESQTNISGSKVVGVDLGVVHPITASTEDKAVLYNGGVLNSKLRYRNKKLAELQKKLSRKKVGSRRYRKLVRAKRRLLGKIQNQIKDILHKYTTHFVGWCLTEGVGTIAIGDLRGIRDRVDYSTKVNQKIHQWLFRKISDLIKTKAEALGIEVVFVDESYTSQTCPVCGKRHKTSTRNFRCLGCGFEWHRDAVGALNIKRKYTGESLVVGALASPVGVMYNSHLRCPVVMWSPWKPTFEWVKTS

SEQ ID NO: 818 - protein, 390 aa, Streptomyces griseus
MKLVVQVKLLPTPEQASALQATLHACNQAANHVSTIAHATGTKDNRALRAETYTQVKSTWGLGAQAAQHVIKKTCDAYAALKGSLRAGILGRPGSKPYKAATGKPVVFRPTAAQPYDDRMLSWQTEQRTVSIWTTAGRLKRLPYTGSEHQLQLLDQYRRGESDLITRGGQWYLLATLDIPEPAVNPDPQGFIGVDLGIANIATTSTGHRHSGRRLNRTRENDRKLRTRLQQKGTRSAKRRAKRHAGKEARRTRDINHKISKHIVAEAQRTGRGIALEDLGGIRERARLKKPQRVTMNSWAFGQLAEFIAYKARRAGVPVVYVNPAYTSQECSRCHHIDKRNRPRQAVFTCRSCGFVEHADLNASHTISLRGWSAWVRGAESQVPALTLTA

SEQ ID NO: 819 - protein, 358 aa, Exiguobacterium acetylicum
MSQVVTVEVRIYATRRQDAILKRMGKTYIQTANRVVANMVASEDGKRWSSKDIDTPLPSAVKNQLAGDAVGIYKKARKEDFKRIPVLKKPVCVWNNQNYSFDFESISFPVWMDGKSVKMRFRAAMVDKDNRNTRLLANKLGTLRVTKKGRKWIAQISVHVPTVPRTGMRVMGVDLGLKVPAVAVTDDDTTRFFGNGRKNKYMKRKFRAERKALGKKKKPKAIKRRNQKEQRWMRDKDHKVSRAIVDFARQKKISVIRLELLANIRQTARTSRKNNQNLHSWSFYRLASFIEYKAALSGIKVEYVNPAYTSQTCPSCSVRNKVRDRVYTCACGFKGHRDAVGAMNIRYAPVMDGNSPSA

SEQ ID NO: 820 - protein, 358 aa, Exiguobacterium indicum
MSQVVTVEVRIYATRRQDAILKRMGKTYIQTANRVVANMVASEDGKRWSSKDIDTPLPSAVKNQLAGDAVGIYKKARKEDFKRIPVLKKPVCVWNNQNYSFDFESISFPVWMDGKSVKMRFRAAMVDKDNRNTRLLANKLGTLRVTKKGRKWIAQISVHVPTVPRTGVRVMGVDLGLKVPAVAVTDDDTTRFFGNGRKNKYMKRKFRAERKALGKKKKPKAIKRRNQKEQRWMRDKDHKVSRAIVDFARQKKISVIRLELLANIRQTARTSRKNNQNLHSWSFYRLASFIEYKAALSGIKVEYANPAYTSQTCPSCSVRNKVRDRVYTCACGFKGHRDAVGAMNIRYAPVMDGNSPSA

SEQ ID NO: 821 - protein, 350 aa, Thermococcus sp. PK
ITSFYRLKKETYKGLRREYPDLPSHYIHTACQMATSIYKSYRKRKRRGKANGKPVFKKKVIMLDDHLFKLDLEGGFIKLSTPSGRLKLEFYPAKYHEKFREWKIGQAWLVKNQMGIFLHVVFSKEVEVREPKVIVGVDLNENNVTLSLPDGEFIQIITHEREIRTGYFVKRRKIQRKLRAGKKREELLEKYGRRERNRLNDLYHKLANKIVELAEKYGGITLEDLTEIRNTIRYSAEMNGRLHRWSFRKLQSIIEYKAKLKGVSVVFVDPAYSSSLCPICGGKLSPNGHRVLKCSNCGFEADRDVVGSWNIRLKALKMWGVSVPPESPPMKTGGGKPTRYEINALHALYW

SEQ ID NO: 822 - protein, 377 aa, Escherichia coli
MLRTACIRLDVKVEQSKQLSVLREVYADACNRLVSVVCEHRIWNRVGLHNMVYRDLREHTPLGSQMCCNVIFSVCKAYKSQKERGHIHKAKAVPTIRFNGTSVHFDKKTYSLRDNSLSLYTLNGRIRVPMIIGEHQQRMLSSGHPKEAELVFRKGLWFFNLVVEITDTTMVVSEKTMGVDMGENNLAAHSLGELFGGEQLRDERDRHLALRRRLQSNGSQSAKQKLRQVSGKEMRRVKQTNHETSKVIVAAAAEAGIGTIILEDLTHIRDRIKAGKRVRSRLHRWAWRQLQTFIEYKARAVGIMVKYVNPAYSSQSCSCCGCLGKRHKHRFECPHCGFRAHSDLNASRNLAWIGETAVLPRASVNTPDVGSPSLAPQ

SEQ ID NO: 823 - protein, 377 aa, Enterobacteriaceae
MLRTACIRLDVKVEQSKQLSVLREVYADACNRLVSVVCEHRIWNRVGLHNMVYRDLREHTPLGSQMCCNVIFSVCKAYKSQKERGHIHKAKAVPTIRFNGTSVHFDKKTYSLRDNSLSLYTLNGRIRVPMIIGEHQQRMLSSGHPKEAELVFRKGLWFFNLVVEITDTTMVVSEKTMGVDMGENNLAAHSLGKLFGGEQLRDERDRHLALRRRLQSNGSQSAKQKLRQVSGKEMRRVKQTNHETSKVIVAAAAEAGIGTIILEDLTHIRDRIKAGKRVRSRLHRWAWRQLQTFIEYKARAVGIMVKYVNPAYSSQSCSCCGCLGKRHKHRFECPHCGFRAHSDLNASRNLAWIGETAVLPRASVNTPDVGSPSLAPQ

SEQ ID NO: 824 - protein, 358 aa, Bacillus sp. T33-2
MSQTITVKIKLLPTKEQALILTEMSKTYISTINELVSEMVKEKKATKKSSKNVDVSLPSAVKNQAVKDAKSVFKKAKKTKFETVPVLKKPMCIWNNQNYSFDFTHISLPIMVDGKAKKTPIRALLVDKDNRNFDLLKHKLGTLRITKKSDKWIAQISITIPTVQKTGLKVMGVDLGLKVPAVAVTDDEKVRFFGNGRHNKYKKRKFRSVRKALGKKKKLNAIRHSKNKEQRWMEDQDHKVSRAIVNFAKENKISVIRLEQLANIRQTTRTSRKNEKNLHTWSFYRLSQFIEYKAELEGIKVEYANPAYTSQTCPKCSEKNKAQDRKYKCKCGFEKHRDIIGAMNIRYAPVVDGKSQSA

SEQ ID NO: 825 - protein, 426 aa, Halorubrum distributum
MAKQVVTRTYTASIRNQSRVQDDLDSLGFAASKLWNVGRWTCSRIWDEIDHIPNHNELTTYLKTHERYDDLHSQSSQRVLQELTEAFNGWYGKRRSGDTRANPPGYRKHGDEHPRSTVTFKAAGFKLDTQYNRVRLSKGSNLKEYWSDFILCEYQTRPDVDLSIVENVQQVRTVWTGEKWELHFVCKVEIDVAEAPGEKTVGVDLGINNFAALAYEDGHSELYPLNCLKQDDYYFSKRIARCDDSNSEQATRLNQKKSARRTHYFHTLSKNIVERCVEEGVGTIVVGDLSGIREDDDTDESKNWGKHGNLDLHSWAFDRFTDLLEYKAEMEGIVVEEVSEEDTSKSCSCCGRKRDANRVERGLYVCDECGTVANADVNGAENIRQKVSPSSPTLSVNRSNGWLAQPSTFLFDKETGAFAPQERATS

SEQ ID NO: 826 - protein, 392 aa, Thermococcus sp. PK
MPSETIKLTAKFKLKTEPEGLEDLFTLYQEIVNFLITYAFENNITSFYRLKKETYKSLREQYPELPSHYIHTACQMATSIYKSYRKRKRKGKANGKPIFKKQVIMLDDHLFKLDLEEGIIKLSTPSGRLELEFYPAKHHEKFREWKIGQAWLVKNPKGVFLHVVFSKEVEVRESKAVVGVDLNENNVTLSLPDGEFIQIITHEREIRTGYFLKRRRIQKKIRSGKKRKWILEKYGMRERNRINDLYHKLANKIVELAEKYGGITLEDLTEIRNTIRYSAEMNGRLHRWSFRRLQAIIEYKAKLKGVSVVFVDPARTSSLCPICGGKLVPNGRRVLKCECGFEADRDVVGSWNIRLKALKMWGVSVPPESQPMKTGGWKPTRYEINALHALYW

SEQ ID NO: 827 - protein, 390 aa, Actinomadura sp. CNU-125
MVTIVKVMVQVKLLPDAVQAAALKRTLPEINEAANWVSAVSFENLALKACVRDLRNLCYGELKARGFGAQAAQHIIKRVADAYTSLRAAIRAGNFGPNGSRSRRKVDSRPIMFRPHAAHTYDDRCLSWNYDRRTVSIWTLDGRVKNVRFACSSSALRQLADYRRGESDLLFRDGKWLLAATCEMPEARQYEPSGFIGVDRGITNLATTSDGHDHSGRRLGRYRRWQARKRAELQAKKTRSARQALKKRSRREARHAAHINHKIAKTVVAVAQRTERGIALEELGGIRERVTVPRDQRARLSSWPFHRLGAFIAYKAKRAGVPFIEVDPAHTSQRCPRCGHTGRANRRTRDHFSCRRCGLAGPADHVAAVNIAERAATAWVFVNMPQPAPT

SEQ ID NO: 828 - protein, 360 aa, Armatimonadetes bacterium 13_1_40CM_64_14
MNQVETIRLHPTDPAQLIAWLERFNAAANWLSGVAFRERLWHWLPLQRRAYREVRERFQLPAAATVVVIRKVAYVYRNKKRRQHQATFRRRGAIPVYQHRYKRDGTVSVYGFRIPFTARPQAWLSSRQQAVLCYRRGKFILHQVVEVDVPAPVPVQEYLGCDLGTVNLLTDSETEAYSGQAVEEKRRIYVHRRARLQKRGTRAARRKLRALSGRQRRYQRDVNHGIAKRVVAKAQRLCCGIALEDLRGIRDRIKARRRQRARLHNWAFGQLRQFIVYKAAKAGVPVVFVDPANTSRTCPVCGHVDKRNRRSQAEFSCRRCGHAGPADVIAARNVRAWAHGDAPMVASARAATSPYPTSRG

SEQ ID NO: 829 - protein, 410 aa, Natrinema versiforme
MVATTTKTLEATLAPPTANKEQRLERTVATYRRALLDAFESGAETQTAVNDIVTPYTLTSYAKDALKSYVPQLRNTYNTSELEGNHPVRFTNRGFRIDHSDEREHEFCWRVPQAGRGNAFWIPLRINPEQESLWFDLLDESVTVGEFRLQQHRTNWMLHVTVEYEVAEPEISDEPTRVGFDIGESKLLTGCACQNDTPTQPFIYDGGRSRALRKEMHTTLKRLQERDAEQWRVDERFDHYQNALTDIVEKASREAVEYAQQFEDPVIVLEDLSYIRENLDYGKYMNRRLHSWAFARLTERIEDKALEAGIPIEFVNPRYTSQTCHACGHIGRRGSQAEFTCTNPECWVSEYQADINAAANIAGRVDPWGESVSWKSDRDDSPRDGSTLDSATARREPSAKLAQTTLAEWG

SEQ ID NO: 830 - protein, 144 aa, Rhodococcus opacus
MRHFTSASAEAGPFMAGGSRSALRGRAGTARGIVLEDLSGIRERVRLAKAQRQQLHSWAYAQLRDFVTYKAASVGVPVEVINPRNTSRTCYPCGHVDKANRITQDRFVCRVCGHVDQADHNAALNIGYLGYVKYMTTTHGYWAA

SEQ ID NO: 831 - protein, 411 aa, Candidatus Methanoperedenaceae archaeon HGW-Methanoperedenaceae-1
MIKSYIYIPHKLTKIKEETLDEMCLEFMKVCNDFTKLLPSIQKKRVLKNDRVKWSLPSTTSKDNAYNKWVKNGTIKSNLNSLAIHSAKVEAVGKFKMWLEDKTAEKPLFKTPFIDFNNQSYFIIRKNENTFILDVPSFKNEKGYPRLLIPFNVDSNRSLSKYLKKSIIIGERKRADELKLSESKYANSHIIIPFDDGINEPDEYTPHTFIGIDRGINNIIALSVCDNSGKVLRTKLFGGNELRHYRTKHQHRREKLQAIYGKDKGMIRRTLGKHESKFAKTLNHQISHEVVEISKKYPSPVIVIEDLHRFAKNLRWSFYQLEEFITYKAKINGIVTKKVKAQYTSQTCSRCGHVDKANRYGVKFACDKCGHRDNADINAAINISRSYINEVAGKQVLPVTGGVSLPLSPAR

SEQ ID NO: 832 - protein, 377 aa, Escherichia coli
MLRTACIRLDVKVEQSKQLSVLREVYADACNRLVSVVCEHRIWNRVGLHNMVYRDLREHTPLGSQMCCNVIFSVCKAYKSQKERGHIHKAKAVPTIRFNGTSVHFDKKTYSLRDNSLSLYTLNGRIRVPMIIGEHQQRMLSSGHPKEAELVFRKGLWFFNLVVEITDTTMVVSEKTMGVDMGENNLAAHRLGKLFGGEQLRDERDRHLALRRRLQSNGSQSAKQKLRQVSGKEMRRVKQTNHETSKVIVAAAAEAGIGTIILEDLTHIRDRIKAGKRVRSRLHRWAWRQLQTFIEYKARAVGIMVKYVNPAYSSQSCSCCGCLGKRHKHRFECPHCGFRAHSDLNASRNLAWIGETAVLPRASVNTPDVGSPSLAPQ

SEQ ID NO: 833 - protein, 411 aa, Streptomyces sp. Ag82_O1-15
MKIVVQVRLMPTPEVASALECTLRTANESANWLSGQAYERGETSRKALQGFAYHDLKSRGLSAQPALHVLRKVADAYTTLHANIRAGNLGKPGSKRRAKAESQPIAFRLDAAQPYDDRCLSWQVDERTVSIWTTAGRIRGVRFACSEQARKLLADHRKGESDLVHRDGMWLLIATCEIPEPDVFEPDGFIGVDLGIANIATTSTGYLAAGRGLNRHRKRQLDLRRKLQAKGTKSAKRRLKHRSRKESRHAANVNHIISKKIVTEAERTSHGIALEDLGGIRQRVRLRKPQRVTLHSWAFAQLGQFLEYKARRAGVPLVYAGPAYTSQECAECHHIEKKNRVDQARFICRRCGVVAHADRNASRNIAARGEAAWIAGRESRVPAPHNRVSGRRSQPSSQLGTTSKPGPLGLG

SEQ ID NO: 834 - protein, 383 aa, Actinomadura sp. CNU-125
MVQVKLLPDAVQAAALKRTLPEINEAANWVSAVSFENLALKACVRDLRNLCYGELKARGFGAQAAQHIIKRVADAYTSLRAAIRAGNFGPNGSRSRRKVDSRPIMFRPHAAHTYDDRCLSWNYDRRTVSIWTLDGRVKNVRFACSSSALRQLADYRRGESDLLFRDGKWLLAATCEMPEARQYEPSGFIGVDRGITNLATTSDGHDHSGRRLGRYRRWQARKRAELQAKKTRSARQALKKRSRREARHAAHINHKIAKTVVAVAQRTERGIALEELGGIRERVTVPRDQRARLSSWPFHRLGAFIAYKAKRAGVPFIEVDPAHTSQRCPRCGHTGRANRRTRDHFSCRRCGLAGPADHVAAVNIAERAATAWVFVNMPQPAPT

SEQ ID NO: 835 - protein, 393 aa, Thermococcus celericrescens
MSSETIKLTAKFKLKETSEGLDDLFSTYREIVNYLINYAFENSITSFYRLKKETYKSLRKEYSELPSHYHYTACQMATAIFKSYRKRKKKGKAKGKPVFKKEVIMLDDHLFKLDLEAGIIKLSTPSRRVRLEFYPAKYHEKFKGWKIGQAWLVRTPKGVFINVVFSREVEVREPKTFVGVDLNENNVTLSLPNGEFIQIITHERKIRTGYFVKRRKIQKKLRAGKNRKELLEKYGQRERNRLNDLYHKLANKIVELAEKYGGIALEDLTEIRNSIRYSAEMNGRLHRWSFRKLQSIIEYKAKLKGVRVVFVNPAFTSSLCPICGEKLSPKGHRVLKCPKCGFEADRDVVGSWNIRLRALKMWGVTVPPESPTMKMGVGKVSRNDVYELYKSYG

SEQ ID NO: 836 - protein, 403 aa, Streptomyces sp. NRRL B-24720
MLGFGSHCGDIGQCTITAVKIVTQVKLLPEAGQAAALGATLRTVNEAACWVSGVAFERGVPREYELRKHTYAELKARGLGAQAAQHVIKKTRDAYTTLKATIRAGNLGKPGSKRRDKARSKPITFRPQAAQPFDDRCLSWQYDAKTVSIWTTAGRLRGVRFLCSPDALKMLREHRKGESDLIERDGVFYLIAVCDIPEAEQYEPSGFIGVDLGITNIVTTSTGYRAAGRGLNRHRKRQLDLRKKLQAKGTKSAKRLLKKRSRKEARHSANTNHIVSKTIVTTAERTGSGIALEDLTGIRSRVRLRKDQRTPLHSWSFHQLGQYIEYKAKRAGVPLIYVDPAYTSQQCSECGHIDRRNRQSQSTFACRSCGAFMHADDNASHNIGRKGETMWTAGRESRVPATP

SEQ ID NO: 837 - protein, 385 aa, Streptomyces griseus
MKIVTQVKLIPKADQAAALRSTLRTVNEAANWVSGVAFERSVPREYELRKHTYAELKAQGLGAQAAQHVIKKTRDAYTTLKANIKAGNLGKPASKRRRKAESKPIVFRPEAAQPYDDRCLSWQYDQQTVSIWTTAGRLRGVRFACSPDALRMLREHRKGESDLIERDGAFYLIAVCDIPEPEVYEPAGFVGVDLGIVNIATASTGYRAAGRGLNRHRKRQLDLRKKLQAKGTKSAKRLLKKPSRKEARHTANVNHIISKTIVTTAERTGSGIALEDLTGIRSRVRLRKDQRTSLHSWSFHQLGQYIEYKAKRAGVPLVYVDPAYTSQQCSECGHIDRKNRVDQATFACRSCGALMHADDNASHNIGRMAKTVWTAGRESRVPAIP

SEQ ID NO: 838 - protein, 358 aa, Bacillus clausii
MSQTITVKIKLLPTKEQASILREMSQAYISTINTLVSEMVAEKKSTRKSSKDISASLPSAVKNQAIKDAKSVFKKAKKNKFTIVPMLKKPVCIWNNQNYSFDFTHISMPIMIDGKATKTPIRALLVDKDNRNFDLLKHKLGTLRITQKSGKWIAQISVTIPTSEKTGTKIMGVDLGLKVPAVAVTDDDKVRFFGNGRQNKYVKRKFRSERKALGKKKKLNAIRRLKDKEQRWMKDQDHKVSRAIVNFAKENKISVIRLERLANIRQTARTSRKNEKNLHSWSFYRLSQFIEYKANLDGIKVEYVNPAYTSQTCPKCHEKNKAQDRKYKCKCGFEKHRDLVGAMNIRYAPVVDGNSQPA

SEQ ID NO: 839 - protein, 382 aa, Verrucomicrobium sp. 3C
MMRTASIKLDASPEQRAALAALQSDFANACQRLSAVVREHRVWNRVALHQRTYSDLRSSTPLGSQMCCNAIFSVCKAYKALKVTGRIPKDTPVPAISFQRASVHFDKRTYALKKNAVSLYTLGGRVIVPMRLGEHQRRILSFGRPKEAELVFRKGNWYFNLVVESDDKEPIASGPVMGVDVGENNLAAHSLGGIFGGGRLCDRRDRHLALRRRLQSNGSRSAKQKLRQVSGKERRHVTHVNHETSKAIVREALEAGVAKIMMEDLTHIRDRIKAGKRMRGRLHRWAFRQLQRFVEYKAKSAGIAVEYVDPAYTSQTCSSCKQLGRRTKHRFACPHCGLRAHSDLNASRNLARIGGTMVPPRAAVSTSNVGGADVGNHVCASR

SEQ ID NO: 840 - protein, 393 aa, Thermococcus kodakarensis KOD1
MPSETIKLTAKFKLKNPPEELNDLFSTYREIVNHLISYAFENNVTSFYRLKKETYKSLRKEYPELPSHYHYTATQMATMIYKSYRKRKKKGKANGRPVFKKDAIMLDDHLFKLDLEAGVIKLSTPSGRVELEFYPSKYHEKFRDWKIGQAWLVRTPKGVFINVVFSREVEVREPEAFVGVDLNENNVTLSLPNGEFVQILTHEREIRTGYFLKRRKIQKKLRTRKKRKELLEKYGQRERNRLDDLYHKLANKIVELAERYSGIALEDLTEIRDSIRYSAEVNGRLHRWSFRKLQNIIEYKAKLKGIKVVFVNPAYTSSLCPVCGRKLSPNGHRVLKCPKCGFEADRDVIGSWNISLRALKMWGVSVPPESPTMKTGVGKVGRSDVYELYTNYG

SEQ ID NO: 841 - protein, 427 aa, Sutterella wadsworthensis
MSVRKPSGITLKGLNISKGAGKLVRRKVDVRTVCIALEVDADASEKMHQTRRLYGQACNLLVPIVVSDTDRKKRLWQRYNLHKAAYPMVRTKMSVLGAQLACNVMRSVSSMYQSWISNHPNFSKDKKMVLPSISFRNPVVHLDKNTIRFFNNYTEASVYTVNGRVGVRLRPGKFQLSQLAGFLAEELAGTSKENRIYRLGECNLVWKCGIKGTPSRWELHIAIEKKLEEVSLDNLSLNQVMGVDVGENNAAALSTGRIFKAGKMKDDRDKYLSSRARFQRNGSRSARQALRKASGREKRHVEQINDEISKSIIEDVAERNIRLIVLEDLTDIRERIKAGQKVRARLHRWPFRELQQKIVDKACRAGIEVIFVDPRYTSQTCPHCNAIGTRQKHRFVCKNCGYRAHSDLNGGRNLQRLGCLLITQGLV

SEQ ID NO: 842 - protein, 188 aa, Ornithinibacillus halophilus
MGVDLGLKVPAVAVTDDEKVRFFGNGRENKYKKRNFRSFRKALGKKKKLNAIRNSKNKEQRWMEDKDHKVSRAIVNFAKENKISVIRLERLANIRQTTRTSRKNEKNLHTWSFYRLSQFIEYKAELEGIKVEYVNPAYTSQTCPKCSQRNKAQDRKYTCKCGFEKHRDIVGAMNIRYAPVVDGNSQSA

SEQ ID NO: 843 - protein, 427 aa, Sutterella wadsworthensis
MSVRKPSGITLKGLNISKGAGKLVRRKVDVRTVCIALEVDADASEKMHQTRRLYGQACNLLVPIVVSDTDRKKRLWQRYNLHKAAYPMVRTKMSVLGAQLACNVMRSVSSMYQSWISNHPNFSKDKKMVLPSISFRNPVVHLDKNTIRFFNNYTEASVYTVNGRVGVRLRPGKFQLSQLAGFLAEELAGTSKENRIYRLGECNLVWKCGIKGTPSRWELHIAIEKKLKEVSLDNLSLNQVMGVDVGENNAAALSTGRIFKAGKMKDDRDKYLSSRARFQRNGSRSARQALRKASGREKRHVEQINDEISKSIIEDVAERNIRLIVLEDLTDIRERIKAGQKVRARLHRWPFRELQQKIVDKACRAGIEVIFVDPRYTSQTCPHCNAIGTRQKHRFVCKNCGYRAHSDLNGGRNLQRLGCLLITQGLV

SEQ ID NO: 844 - protein, 350 aa, Bacillus velezensis
MKLFPTKEQASILREMSQTYISTINTLVSEMVAEKRSTRKSSKDISASLPSAVKNQAIKDAKSVFKKAKKNKFNVVPMLKKPVCIWNNQNYSFGFTHILMPIMIDGKAAKTPIRALLVDKDNRNFHLLKHKLGTLRITQKSGKWIAQISVTIPTSEKTGTKIMGVDLGLKVPAVAVTDDDKVRFFGNGRQNKYIKRKFRSERKALGKKKKLNAIRRSRDKEQRWMKDQDHKVSRAIVTFAIENKISVIRLEQLANIRQTARTSRKNEKNLHIWSFYRLSQFIEYKANLEGIKVEYVKPAYTSQTCPKCHEKNKAQDRKYKCKCGFEKHRDLVGAMNIRYAPVVDGNSQPA

SEQ ID NO: 845 - protein, 362 aa, Halanaerobium praevalens
MQLTYILELLKPTKRKENIFLNNIAEVVKNRQAVAAKLKAGETNLSSADFKEINLPAAVKNQNIREVKAFHKLFLKSGSDKDNIEFKANQPICYNNQNYTIDHHIISIPFYTTKCQRFAFPVKQTERFEKLQQHIDSGCKLGKACLFYKRGKWYFAVTIKIAVKKNTNSNLMGIDIGLRQFAVASVKTHRGKEINCQFHNGKQAGFIRKKYRMLRRKLGQSKKVKAIKNINDKEQRWMTDLNHKISRQLINLAVQEQVGTIIMENLENIRNTAKSLNRADRNIHSWTFYQLQQFIEYKAELAGIKVEYINPKYTSQSCSKCNKVKKSNRKANLYSCECGNHIHADLNASRNIANKYLEQQSA

SEQ ID NO: 846 - protein, 267 aa, Thermomonas hydrothermalis
TVSLYTLDGRITVPMRLGEHQRRILGSGQPKEAELVLRKGQWFFNLVVETDDAQPVASGPVMGVDVGENNLAAHSLGRVFGGERLRDKRDRYLALRRRLQSNGSQSAKQKLRQVSGKEMRRVKHINHETSKAIVQAAIDAGIAKITMEDLTHIRERIKAGKRMRGRLHRWAWRQLQTFVEYKAKAAGIAVEYANPAYTSQTCSCCGELGKRSKHRFECPHCGLRAHSDLNASRNLARIGSGAPLSRAVVNTPDVGSVDMGNHVCASQ

SEQ ID NO: 847 - DNA, 8282 bp, Artificial Sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgagacctctgtcttgtcagctagggtggtctcgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 848 - DNA, 8282 bp, Artificial Sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 849 - DNA, 8496 bp, Artificial Sequence
  Synthetic
cgggatctcgacgctctcccttatgcgactcctgcattaggaaattaatacgactcactataggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacgatataccatgggtgaactgccgagtaggtagctgataacgagacctctgtcttgtcagctagggtggtctcgtgaactgccgagtaggtagctgataacggatccgaattcgctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtc

SEQ ID NO: 850 - DNA, 8496 bp, Artificial Sequence
  Synthetic
cgggatctcgacgctctcccttatgcgactcctgcattaggaaattaatacgactcactataggggaattgtgagcggataacaattcccctgtagaaataattttgtttaactttaataaggagatataccatgggcagcagccatcaccatcatcaccacagccaggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacgatataccatgggtgaactgccgagtaggtagctgataacagtacagcgcggctgaaatcatcattaaagcggtgaactgccgagtaggtagctgataacggatccgaattcgctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtc

SEQ ID NO: 851 - DNA, 11975 bp, Artificial Sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgagacctctgtcttgtcagctagggtggtctcgtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 852 - DNA, 11975 bp, Artificial Sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagctcggcgcgcctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 853 - DNA, 11812 bp, Artificial Sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacgagacctctgtcttgtcagctagggtggtctcgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 854 - DNA, 11812 bp, Artificial Sequence
  Synthetic
attcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcac

SEQ ID NO: 855 - DNA, 12022 bp, Artificial Sequence
  Synthetic
ctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggcagcagccatcaccatcatcaccacagccaggatccgaattcgagctcggtataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgccctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacgatataccatgggtgaactgccgagtaggtagctgataacgagacctctgtcttgtcagctagggtggtctcgtgaactgccgagtaggtagctgataacggatccgaattcgctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccg

SEQ ID NO: 856 - DNA, 12022 bp, Artificial Sequence
  Synthetic
ggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatgggcagcagccatcaccatcatcaccacagccaggatccgaattcgagctcggtataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgccctgcaggtcgacaagcttgcggccgcataatgcttaagtcgaacagaaagtaatcgtattgtacacggccgcataatcgaaattaatacgactcactataggggaattgtgagcggataacaattccccatcttagtatattagttaagtataagaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacgatataccatgggtgaactgccgagtaggtagctgataacagtacagcgcggctgaaatcatcattaaagcggtgaactgccgagtaggtagctgataacggatccgaattcgctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgca

SEQ ID NO: 857 - DNA, 11866 bp, Artificial Sequence
  Synthetic
cgggatctcgacgctctcccttatgcgactcctgcattaggaaattaatacgactcactataggggaattgtgagcggataacaattcccctgtagaaataattttgtttaactttaataaggagatataccatgggcagcagccatcaccatcatcaccacagccaggatccgaattcgagctcggtataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctggaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacgatataccatgggtgaactgccgagtaggtagctgataacgagacctctgtcttgtcagctagggtggtctcgtgaactgccgagtaggtagctgataacggatccgaattcgctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtc

SEQ ID NO: 858 - DNA, 11866 bp, Artificial Sequence
  Synthetic
cgggatctcgacgctctcccttatgcgactcctgcattaggaaattaatacgactcactataggggaattgtgagcggataacaattcccctgtagaaataattttgtttaactttaataaggagatataccatgggcagcagccatcaccatcatcaccacagccaggatccgaattcgagctcggtataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctggaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacgatataccatgggtgaactgccgagtaggtagctgataactgggaggattcataaagcattgtttgttggctgtgaactgccgagtaggtagctgataacggatccgaattcgctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtc

SEQ ID NO: 859 - DNA, 11979 bp, Artificial Sequence
  Synthetic
tttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacgagacctctgtcttgtcagctagggtggtctcgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcact

SEQ ID NO: 860 - DNA, 11979 bp, Artificial Sequence
  Synthetic
tttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaactaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcact

SEQ ID NO: 861 - DNA, 11353 bp, Artificial Sequence
  Synthetic
tttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagcccaagctttgttgatacaaccataaaatgataattacacccataaattgataattatcacacccataaattgatattgcctcttcatggtctaaacttcagtaagtttacgacattttcctcgaggtcatttccggggcgactcctgcattaggaaattaatacgactcactataggggaattgtgagcggataacaattcccctgtagaaataattttgtttaactttaataaggagatataccatgggtgaactgccgagtaggtagctgataacgagacctctgtcttgtcagctagggtggtctcgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcact

SEQ ID NO: 862 - DNA, 11358 bp, Artificial Sequence
  Synthetic
tttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagcccaagctttgttgatacaaccataaaatgataattacacccataaattgataattatcacacccataaattgatattgcctcttcatggtctaaacttcagtaagtttacgacattttcatgaactcgaggtcatttccggggcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcact

SEQ ID NO: 863 - DNA, 11927 bp, Artificial Sequence
  Synthetic
tttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggattgacagctagctcagtcctaggtataatactagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcact

SEQ ID NO: 864 - DNA, 11927 bp, Artificial Sequence
  Synthetic
tttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggatttacagctagctcagtcctaggtattatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcact

SEQ ID NO: 865 - DNA, 11927 bp, Artificial Sequence
  Synthetic
tttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggatttacggctagctcagtcctaggtactatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcact

SEQ ID NO: 866 - DNA, 11927 bp, Artificial Sequence
  Synthetic
tttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggatttatggctagctcagtcctaggtacaatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcact

SEQ ID NO: 867 - DNA, 14288 bp, Artificial Sequence
  Synthetic
accttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaacgaccgagcgcagcgagtcagtgagcgaggattgacagctagctcagtcctaggtataatactagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccattttttaaccaataggccgtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattgccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgag

SEQ ID NO: 868 - DNA, 14288 bp, Artificial Sequence
  Synthetic
accttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaacgaccgagcgcagcgagtcagtgagcgaggatttacagctagctcagtcctaggtattatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccattttttaaccaataggccgtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattgccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgag

SEQ ID NO: 869 - DNA, 14288 bp, Artificial Sequence
  Synthetic
accttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaacgaccgagcgcagcgagtcagtgagcgaggatttacggctagctcagtcctaggtactatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccattttttaaccaataggccgtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattgccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgag

SEQ ID NO: 870 - DNA, 14288 bp, Artificial Sequence
  Synthetic
accttcgggagcgcctgaagcccgttctggacgccctggggccgttgaatcgggatatgcaggccaaggccgccgcgatcatcaaggccgtgggcgaaaagctgctgacggaacagcgggaagtccagcgccagaaacaggcccagcgccagcaggaacgcgggcgcgcacatttccccgaaaagtgccacctgggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacccccatgggcaaatattatacgcaaggcgacaaggtgctgatgccgctggcgattcaggttcatcatgccgtttgtgatggcttccatgtcggcagaatgcttaatgaattacaacagtttttatgcatgcgcccaatacgcaaaccgcctctccccgcgcgttggccgattcattaatgcagctggcacgacaggtttcccgactggtggataaccgtattaccgcctttgagtgagctgataccgctcgccgcagccgaacgaccgagcgcagcgagtcagtgagcgaggatttatggctagctcagtcctaggtacaatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccattttttaaccaataggccgtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgaggcggctacagccgatagtctggaacagcgcacttacgggttgctgcgcaacccaagtgctaccggcgcggcagcgtgacccgtgtcggcggctccaacggctcgccatcgtccagaaaacacggctcatcgggcatcggcaggcgctgctgcccgcgccgttcccattcctccgtttcggtcaaggctggcaggtctggttccatgcccggaatgccgggctggctgggcggctcctcgccggggccggtcggtagttgctgctcgcccggatacagggtcgggatgcggcgcaggtcgccatgccccaacagcgattcgtcctggtcgtcgtgatcaaccaccacggcggcactgaacaccgacaggcgcaactggtcgcggggctggccccacgccacgcggtcattgaccacgtaggccgacacggtgccggggccgttgagcttcacgacggagatccagcgctcggccaccaagtccttgactgcgtattggaccgtccgcaaagaacgtccgatgagcttggaaagtgtcttctggctgaccaccacggcgttctggtggcccatctgcgccacgaggtgatgcagcagcattgccgccgtgggtttcctcgcaataagcccggcccacgcctcatgcgctttgcgttccgtttgcacccagtgaccgggcttgttcttggcttgaatgccgatttctctggactgcgtggccatgcttatctccatgcggtaggggtgccgcacggttgcggcaccatgcgcaatcagctgcaacttttcggcagcgcgacaacaattatgcgttgcgtaaaagtggcagtcaattacagattttctttaacctacgcaatgagctattgcggggggtgccgcaatgagctgttgcgtaccccccttttttaagttgttgatttttaagtctttcgcatttcgccctatatctagttctttggtgcccaaagaagggcacccctgcggggttcccccacgccttcggcgcggctccccctccggcaaaaagtggcccctccggggcttgttgatcgactgcgcggccttcggccttgcccaaggtggcgctgcccccttggaacccccgcactcgccgccgtgaggctcggggggcaggcgggcgggcttcgcccttcgactgcccccactcgcataggcttgggtcgttccaggcgcgtcaaggccaagccgctgcgcggtcgctgcgcgagccttgacccgccttccacttggtgtccaaccggcaagcgaagcgcgcaggccgcaggccggaggcttttccccagagaaaattaaaaaaattgatggggcaaggccgcaggccgcgcagttggagccggtgggtatgtggtcgaaggctgggtagccggtgggcaatccctgtggtcaagctcgtgggcaggcgcagcctgtccatcagcttgtccagcagggttgtccacgggccgagcgaagcgagccagccggtggccgctcgcggccatcgtccacatatccacgggctggcaagggagcgcagcgaccgcgcagggcgaagcccggagagcaagcccgtagggcgccgcagccgccgtaggcggtcacgactttgcgaagcaaagtctagtgagtatactcaagcattgagtggcccgccggaggcaccgccttgcgctgcccccgtcgagccggttggacaccaaaagggaggggcaggcatggcggcatacgcgatcatgcgatgcaagaagctggcgaaaatgggcaacgtggcggccagtctcaagcacgcctaccgcgagcgcgagacgcccaacgctgacgccagcaggacgccagagaacgagcactgggcggccagcagcaccgatgaagcgatgggccgactgcgcgagttgctgccagagaagcggcgcaaggacgctgtgttggcggtcgagtacgtcatgacggccagcccggaatggtggaagtcggccagccaagaacagcaggcggcgttcttcgagaaggcgcacaagtggctggcggacaagtacggggcggatcgcatcgtgacggccagcatccaccgtgacgaaaccagcccgcacatgaccgcgttcgtggtgccgctgacgcaggacggcaggctgtcggccaaggagttcatcggcaacaaagcgcagatgacccgcgaccagaccacgtttgcggccgctgtggccgatctagggctgcaacggggcatcgagggcagcaaggcacgtcacacgcgcattcaggcgttctacgaggccctggagcggccaccagtgggccacgtcaccatcagcccgcaagcggtcgagccacgcgcctatgcaccgcagggattggccgaaaagctgggaatctcaaagcgcgttgagacgccggaagccgtggccgaccggctgacaaaagcggttcggcaggggtatgagcctgccctacaggccgccgcaggagcgcgtgagatgcgcaagaaggccgatcaagcccaagagacggcccgag

SEQ ID NO: 871 - DNA, 11898 bp, Artificial Sequence
  Synthetic
gtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggtggataaccgtattaccgcctttgagtgagctgataccgctcgccgcagccgaacgaccgagcgcagcgagtcagtgagcgaggattgacagctagctcagtcctaggtataatactagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccactcattaggcaccgggatctcgaccgatgcccttgagagccttcaacccagtcagctccttccggtgggcgcggggcatgactaacatgagaattacaacttatatcgtatggggctgacttcaggtgctacatttgaagagataaattgcactgaaatctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccaggggaaacgcctg

SEQ ID NO: 872 - DNA, 11898 bp, Artificial Sequence
  Synthetic
gtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggtggataaccgtattaccgcctttgagtgagctgataccgctcgccgcagccgaacgaccgagcgcagcgagtcagtgagcgaggatttacagctagctcagtcctaggtattatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccactcattaggcaccgggatctcgaccgatgcccttgagagccttcaacccagtcagctccttccggtgggcgcggggcatgactaacatgagaattacaacttatatcgtatggggctgacttcaggtgctacatttgaagagataaattgcactgaaatctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccaggggaaacgcctg

SEQ ID NO: 873 - DNA, 11898 bp, Artificial Sequence
  Synthetic
gtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggtggataaccgtattaccgcctttgagtgagctgataccgctcgccgcagccgaacgaccgagcgcagcgagtcagtgagcgaggatttacggctagctcagtcctaggtactatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccactcattaggcaccgggatctcgaccgatgcccttgagagccttcaacccagtcagctccttccggtgggcgcggggcatgactaacatgagaattacaacttatatcgtatggggctgacttcaggtgctacatttgaagagataaattgcactgaaatctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccaggggaaacgcctg

SEQ ID NO: 874 - DNA, 11898 bp, Artificial Sequence
  Synthetic
gtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggtggataaccgtattaccgcctttgagtgagctgataccgctcgccgcagccgaacgaccgagcgcagcgagtcagtgagcgaggatttatggctagctcagtcctaggtacaatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccactcattaggcaccgggatctcgaccgatgcccttgagagccttcaacccagtcagctccttccggtgggcgcggggcatgactaacatgagaattacaacttatatcgtatggggctgacttcaggtgctacatttgaagagataaattgcactgaaatctagaaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccaggggaaacgcctg

SEQ ID NO: 875 - DNA, 12940 bp, Artificial Sequence
  Synthetic
gagtccaagcgagctctcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatactccttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcagaatttcagataaaaaaaatccttagctttcgctaaggatgatttctggtggataaccgtattaccgcctttgagtgagctgataccgctcgccgcagccgaacgaccgagcgcagcgagtcagtgagcgaggattgacagctagctcagtcctaggtataatactagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcgtataatactagtagctgcggaatcgacgttttagagctagaaatagcaagttaaaataaggctagtccgttatcaacttgaaaaagtggcaccgagtcggtgctttttttataaaacgaaaggctcagtcgaaagactgggcctttcgttttatccgaatacgggttcttgcatgttacattgtcgatctgttcatggtgaacagctttaaatgcaccaaaaactcgtaaaagctctgatgtatctatcttttttacaccgttttcatctgtgcatatggacagttttccctttgatatctaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatgcttactttgcatgtcactcaaaaattttgcctcaaaactggtgagctgaatttttgcagttaaagcatcgtgtagtgtttttcttagtccgttacgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaatcactataccaattgagatgggctagtcaatgataattactagtccttttcccgggagatctgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcttaagtagcaccctcgcaagctcgggcaaatcgctgaatattccttttgtctccgaccatcaggcacctgagtcgctgtctttttcgtgacattcagttcgctgcgctcacggctctggcagtgaatgggggtaaatggcactacaggcgccttttatggattcatgcaaggaaactacccataatacaagaaaagcccgtcacgggcttctcagggcgttttatggcgggtctgctatgtggtgctatctgactttttgctgttcagcagttcctgccctctgattttccagtctgaccacttcggattatcccgtgacaggtcattcagactggctaatgcacccagtaaggcagcggtatcatcaacaggcttacccgtcttactgtccctagtgcttggattctcaccaataaaaaacgcccggcggcaaccgagcgttctgaacaaatccagatggagttctgaggtcattactggatctatcaacag

SEQ ID NO: 876 - DNA, 12940 bp, Artificial Sequence
  Synthetic
gagtccaagcgagctctcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatactccttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcagaatttcagataaaaaaaatccttagctttcgctaaggatgatttctggtggataaccgtattaccgcctttgagtgagctgataccgctcgccgcagccgaacgaccgagcgcagcgagtcagtgagcgaggatttacagctagctcagtcctaggtattatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcgtataatactagtagctgcggaatcgacgttttagagctagaaatagcaagttaaaataaggctagtccgttatcaacttgaaaaagtggcaccgagtcggtgctttttttataaaacgaaaggctcagtcgaaagactgggcctttcgttttatccgaatacgggttcttgcatgttacattgtcgatctgttcatggtgaacagctttaaatgcaccaaaaactcgtaaaagctctgatgtatctatcttttttacaccgttttcatctgtgcatatggacagttttccctttgatatctaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatgcttactttgcatgtcactcaaaaattttgcctcaaaactggtgagctgaatttttgcagttaaagcatcgtgtagtgtttttcttagtccgttacgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaatcactataccaattgagatgggctagtcaatgataattactagtccttttcccgggagatctgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcttaagtagcaccctcgcaagctcgggcaaatcgctgaatattccttttgtctccgaccatcaggcacctgagtcgctgtctttttcgtgacattcagttcgctgcgctcacggctctggcagtgaatgggggtaaatggcactacaggcgccttttatggattcatgcaaggaaactacccataatacaagaaaagcccgtcacgggcttctcagggcgttttatggcgggtctgctatgtggtgctatctgactttttgctgttcagcagttcctgccctctgattttccagtctgaccacttcggattatcccgtgacaggtcattcagactggctaatgcacccagtaaggcagcggtatcatcaacaggcttacccgtcttactgtccctagtgcttggattctcaccaataaaaaacgcccggcggcaaccgagcgttctgaacaaatccagatggagttctgaggtcattactggatctatcaacag

SEQ ID NO: 877 - DNA, 12940 bp, Artificial Sequence
  Synthetic
gagtccaagcgagctctcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatactccttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcagaatttcagataaaaaaaatccttagctttcgctaaggatgatttctggtggataaccgtattaccgcctttgagtgagctgataccgctcgccgcagccgaacgaccgagcgcagcgagtcagtgagcgaggatttacggctagctcagtcctaggtactatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcgtataatactagtagctgcggaatcgacgttttagagctagaaatagcaagttaaaataaggctagtccgttatcaacttgaaaaagtggcaccgagtcggtgctttttttataaaacgaaaggctcagtcgaaagactgggcctttcgttttatccgaatacgggttcttgcatgttacattgtcgatctgttcatggtgaacagctttaaatgcaccaaaaactcgtaaaagctctgatgtatctatcttttttacaccgttttcatctgtgcatatggacagttttccctttgatatctaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatgcttactttgcatgtcactcaaaaattttgcctcaaaactggtgagctgaatttttgcagttaaagcatcgtgtagtgtttttcttagtccgttacgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaatcactataccaattgagatgggctagtcaatgataattactagtccttttcccgggagatctgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcttaagtagcaccctcgcaagctcgggcaaatcgctgaatattccttttgtctccgaccatcaggcacctgagtcgctgtctttttcgtgacattcagttcgctgcgctcacggctctggcagtgaatgggggtaaatggcactacaggcgccttttatggattcatgcaaggaaactacccataatacaagaaaagcccgtcacgggcttctcagggcgttttatggcgggtctgctatgtggtgctatctgactttttgctgttcagcagttcctgccctctgattttccagtctgaccacttcggattatcccgtgacaggtcattcagactggctaatgcacccagtaaggcagcggtatcatcaacaggcttacccgtcttactgtccctagtgcttggattctcaccaataaaaaacgcccggcggcaaccgagcgttctgaacaaatccagatggagttctgaggtcattactggatctatcaacag

SEQ ID NO: 878 - DNA, 12940 bp, Artificial Sequence
  Synthetic
gagtccaagcgagctctcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatactccttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcagaatttcagataaaaaaaatccttagctttcgctaaggatgatttctggtggataaccgtattaccgcctttgagtgagctgataccgctcgccgcagccgaacgaccgagcgcagcgagtcagtgagcgaggatttatggctagctcagtcctaggtacaatgctagccacgtggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaactcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcgtataatactagtagctgcggaatcgacgttttagagctagaaatagcaagttaaaataaggctagtccgttatcaacttgaaaaagtggcaccgagtcggtgctttttttataaaacgaaaggctcagtcgaaagactgggcctttcgttttatccgaatacgggttcttgcatgttacattgtcgatctgttcatggtgaacagctttaaatgcaccaaaaactcgtaaaagctctgatgtatctatcttttttacaccgttttcatctgtgcatatggacagttttccctttgatatctaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatgcttactttgcatgtcactcaaaaattttgcctcaaaactggtgagctgaatttttgcagttaaagcatcgtgtagtgtttttcttagtccgttacgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaatcactataccaattgagatgggctagtcaatgataattactagtccttttcccgggagatctgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcttaagtagcaccctcgcaagctcgggcaaatcgctgaatattccttttgtctccgaccatcaggcacctgagtcgctgtctttttcgtgacattcagttcgctgcgctcacggctctggcagtgaatgggggtaaatggcactacaggcgccttttatggattcatgcaaggaaactacccataatacaagaaaagcccgtcacgggcttctcagggcgttttatggcgggtctgctatgtggtgctatctgactttttgctgttcagcagttcctgccctctgattttccagtctgaccacttcggattatcccgtgacaggtcattcagactggctaatgcacccagtaaggcagcggtatcatcaacaggcttacccgtcttactgtccctagtgcttggattctcaccaataaaaaacgcccggcggcaaccgagcgttctgaacaaatccagatggagttctgaggtcattactggatctatcaacag

SEQ ID NO: 879 - DNA, 11176 bp, Artificial Sequence
  Synthetic
tttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaactaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccaattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcact

SEQ ID NO: 880 - DNA, 13284 bp, Artificial Sequence
  Synthetic
gacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaagaggtcatttccgggtcatctctctgtcctcaaacagtgtcagggtcagcacgatatcttccagaatgtcctcgttttcctcattgtccaggaagtccttgtccttgataattttcagcagatcgtggtatgtgcccagggaggcgttgaaccgatcttccacgccggagatttccacggagtcgaagcactcgattttcttgaagtagtcctctttcagctgcttcacggtcactttccggttggtcttgaacagcaggtccacgatggcctttttctgctcgccgctcaggaaggcgggctttctcattccctcggtcacgtatttcactttggtcagctcgttatacacggtgaagtactcgtacagcaggctgtgcttgggcagcaccttctcgttgggcaggttcttatcgaagttggtcatccgctcgatgaagctctgggcggaagcgcccttgtccaccacttcctcgaagttccagggggtgatggtttcctcgctctttctggtcatccaggcgaatctgctgtttcccctggccagagggcccacgtagtaggggatgcggaaggtcaggatcttctcgatcttttcccggttgtccttcaggaatgggtaaaaatcttcctgccgccgcagaatggcgtgcagctctcccaggtggatctggtgggggatgctgccgttgtcgaaggtccgctgcttccgcagcaggtcctctctgttcagcttcacgagcagttcctcggtgccgtccatcttttccaggatgggcttgatgaacttgtagaactcttcctggctggctccgccgtcaatgtagccggcgtagccgttcttgctctggtcgaagaaaatctctttgtacttctcaggcagctgctgccgcacgagagctttcagcagggtcaggtcctggtggtgctcgtcgtatctcttgatcatagaggcgctcaggggggccttggtgatctcggtgttcactctcaggatgtcgctcagcaggatggcgtcggacaggttcttggcggccagaaacaggtcggcgtactggtcgccgatctgggccagcaggttgtccaggtcgtcgtcgtaggtgtccttgctcagctgcagtttggcatcctcggccaggtcgaagttgctcttgaagttgggggtcaggcccaggctcagggcaatcaggtttccgaacaggccattcttcttctcgccgggcagctgggcgatcagattttccagccgtctgctcttgctcagtctggcagacaggatggccttggcgtccacgccgctggcgttgatggggttttcctcgaacagctggttgtaggtctgcaccagctggatgaacagcttgtccacgtcgctgttgtcggggttcaggtcgccctcgatcaggaagtggccccggaacttgatcatgtgggccagggccagatagatcagccgcaggtcggccttgtcggtgctgtccaccagtttctttctcaggtggtagatggtggggtacttctcgtggtaggccacctcgtccacgatgttgccgaagatggggtgccgctcgtgcttcttatcctcttccaccaggaaggactcttccagtctgtggaagaagctgtcgtccaccttggccatctcgttgctgaagatctcttgcagatagcagatccggttcttccgtctggtgtatcttcttctggcggttctcttcagccgggtggcctcggctgtttcgccgctgtcgaacagcagggctccgatcaggttcttcttgatgctgtgccggtcggtgttgcccagcaccttgaatttcttgctgggcaccttgtactcgtcggtgatcacggcccagcccacagagttggtgccgatgtccaggccgatgctgtacttcttgtcggctgctgggactccgtggataccgaccttccgcttcttctttggggccatcttatcgtcatcgtctttgtaatcaatatcatgatccttgtagtctccgtcgtggtccagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttctta

SEQ ID NO: 881 - DNA, 14266 bp, Artificial Sequence
  Synthetic
cgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaagaggtcatttccggggtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcactgggccaggattctcctcgacgtcaccgcatgttagcagacttcctctgccctctccactgccgaattcctttttcttttttgcctggccggcctttttcgtggccgccggccttttgtcgcctcccagctgagacaggtcgatccgtgtctcgtacaggccggtgatgctctggtggatcagggtggcgtccagcacctctttggtgctggtgtacctcttccggtcgatggtggtgtcaaagtacttgaaggcggcaggggctcccagattggtcagggtaaacaggtggatgatattctcggcctgctctctgatgggcttatcccggtgcttgttgtaggcggacagcactttgtccagattagcgtcggccaggatcactctcttggagaactcgctgatctgctcgatgatctcgtccaggtagtgcttgtgctgttccacaaacagctgtttctgctcattatcctcgggggagcccttcagcttctcatagtggctggccaggtacaggaagttcacatatttggagggcagggccagttcgtttcccttctgcagttcgccggcagaggccagcattctcttccggccgttttccagctcgaacagggagtacttaggcagcttgatgatcaggtcctttttcacttctttgtagcccttggcttccagaaagtcgatgggattcttctcgaagctgcttctttccatgatggtgatccccagcagctctttcacactcttcagtttcttggacttgcccttttccactttggccaccaccagcacagaataggccacggtggggctgtcgaagccgccgtacttcttagggtcccagtccttctttctggcgatcagcttatcgctgttcctcttgggcaggatagactctttgctgaagccgcctgtctgcacctcggtctttttcacgatattcacttggggcatgctcagcactttccgcacggtggcaaaatcccggcccttatcccacacgatctccccggtttcgccgtttgtctcgatcagaggccgcttccggatctcgccgttggccagggtaatctcggtcttgaaaaagttcatgatgttgctgtagaagaagtacttggcggtagccttgccgatttcctgctcgctcttggcgatcatcttccgcacgtcgtacaccttgtagtcgccgtacacgaactcgctttccagcttagggtactttttgatcagggcggttcccacgacggcgttcaggtaggcgtcgtgggcgtggtggtagttgttgatctcgcgcactttgtaaaactggaaatccttccggaaatcggacaccagcttggacttcagggtgatcactttcacttcccggatcagcttgtcattctcgtcgtacttagtgttcatccgggagtccaggatctgtgccacgtgctttgtgatctgccgggtttccaccagctgtctcttgatgaagccggccttatccagttcgctcaggccgcctctctcggccttggtcagattgtcgaactttctctgggtaatcagcttggcgttcagatggggttttcctcgaacagctggttgtaggtctgcaccagctggatgaacagcttgtccacgtcgctgttgtcggggttcaggtcgccctcgatcaggaagtggccccggaacttgatcatgtgggccagggccagatagatcagccgcaggtcggccttgtcggtgctgtccaccagtttctttctcaggtggtagatggtggggtacttctcgtggtaggccacctcgtccacgatgttgccgaagatggggtgccgctcgtgcttcttatcctcttccaccaggaaggactcttccagtctgtggaagaagctgtcgtccaccttggccatctcgttgctgaagatctcttgcagatagcagatccggttcttccgtctggtgtatcttcttctggcggttctcttcagccgggtggcctcggctgtttcgccgctgtcgaacagcagggctccgatcaggttcttcttgatgctgtgccggtcggtgttgcccagcaccttgaatttcttgctgggcaccttgtactcgtcggtgatcacggcccagcccacagagttggtgccgatgtccaggccgatgctgtacttcttgtcggctgctgggactccgtggataccgaccttccgcttcttctttggggccatcttatcgtcatcgtctttgtaatcaatatcatgatccttgtagtctccgtcgtggtccagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaga

SEQ ID NO: 882 - DNA, 15248 bp, Artificial Sequence
  Synthetic
gcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaagaggtcatttccggggtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcactgggccaggattctcctcgacgtcaccgcatgttagcagacttcctctgccctctccactgccgaattcctttttcttttttgcctggccggcctttttcgtggccgccggccttttgtcgcctcccagctgagacaggtcgatccgtgtctcgtacaggccggtgatgctctggtggatcagggtggcgtccagcacctctttggtgctggtgtacctcttccggtcgatggtggtgtcaaagtacttgaaggcggcaggggctcccagattggtcagggtaaacaggtggatgatattctcggcctgctctctgatgggcttatcccggtgcttgttgtaggcggacagcactttgtccagattagcgtcggccaggatcactctcttggagaactcgctgatctgctcgatgatctcgtccaggtagtgcttgtgctgttccacaaacagctgtttctgctcattatcctcgggggagcccttcagcttctcatagtggctggccaggtacaggaagttcacatatttggagggcagggccagttcgtttcccttctgcagttcgccggcagaggccagcattctcttccggccgttttccagctcgaacagggagtacttaggcagcttgatgatcaggtcctttttcacttctttgtagcccttggcttccagaaagtcgatgggattcttctcgaagctgcttctttccatgatggtgatccccagcagctctttcacactcttcagtttcttggacttgcccttttccactttggccaccaccagcacagaataggccacggtggggctgtcgaagccgccgtacttcttagggtcccagtccttctttctggcgatcagcttatcgctgttcctcttgggcaggatagactctttgctgaagccgcctgtctgcacctcggtctttttcacgatattcacttggggcatgctcagcactttccgcacggtggcaaaatcccggcccttatcccacacgatctccccggtttcgccgtttgtctcgatcagaggccgcttccggatctcgccgttggccagggtaatctcggtcttgaaaaagttcatgatgttgctgtagaagaagtacttggcggtagccttgccgatttcctgctcgctcttggcgatcatcttccgcacgtcgtacaccttgtagtcgccgtacacgaactcgctttccagcttagggtactttttgatcagggcggttcccacgacggcgttcaggtaggcgtcgtgggcgtggtggtagttgttgatctcgcgcactttgtaaaactggaaatccttccggaaatcggacaccagcttggacttcagggtgatcactttcacttcccggatcagcttgtcattctcgtcgtacttagtgttcatccgggagtccaggatctgtgccacgtgctttgtgatctgccgggtttccaccagctgtctcttgatgaagccggccttatccagttcgctcaggccgcctctctcggccttggtcagattgtcgaactttctctgggtaatcagcttggcgttcaatttcactttggtcagctcgttatacacggtgaagtactcgtacagcaggctgtgcttgggcagcaccttctcgttgggcaggttcttatcgaagttggtcatccgctcgatgaagctctgggcggaagcgcccttgtccaccacttcctcgaagttccagggggtgatggtttcctcgctctttctggtcatccaggcgaatctgctgtttcccctggccagagggcccacgtagtaggggatgcggaaggtcaggatcttctcgatcttttcccggttgtccttcaggaatgggtaaaaatcttcctgccgccgcagaatggcgtgcagctctcccaggtggatctggtgggggatgctgccgttgtcgaaggtccgctgcttccgcagcaggtcctctctgttcagcttcacgagcagttcctcggtgccgtccatcttttccaggatgggcttgatgaacttgtagaactcttcctggctggctccgccgtcaatgtagccggcgtagccgttcttgctctggtcgaagaaaatctctttgtacttctcaggcagctgctgccgcacgagagctttcagcagggtcaggtcctggtggtgctcgtcgtatctcttgatcatagaggcgctcaggggggccttggtgatctcggtgttcactctcaggatgtcgctcagcaggatggcgtcggacaggttcttggcggccagaaacaggtcggcgtactggtcgccgatctgggccagcaggttgtccaggtcgtcgtcgtaggtgtccttgctcagctgcagtttggcatcctcggccaggtcgaagttgctcttgaagttgggggtcaggcccaggctcagggcaatcaggtttccgaacaggccattcttcttctcgccgggcagctgggcgatcagattttccagccgtctgctcttgctcagtctggcagacaggatggccttggcgtccacgccgctggcgttgatggggttttcctcgaacagctggttgtaggtctgcaccagctggatgaacagcttgtccacgtcgctgttgtcggggttcaggtcgccctcgatcaggaagtggccccggaacttgatcatgtgggccagggccagatagatcagccgcaggtcggccttgtcggtgctgtccaccagtttctttctcaggtggtagatggtggggtacttctcgtggtaggccacctcgtccacgatgttgccgaagatggggtgccgctcgtgcttcttatcctcttccaccaggaaggactcttccagtctgtggaagaagctgtcgtccaccttggccatctcgttgctgaagatctcttgcagatagcagatccggttcttccgtctggtgtatcttcttctggcggttctcttcagccgggtggcctcggctgtttcgccgctgtcgaacagcagggctccgatcaggttcttcttgatgctgtgccggtcggtgttgcccagcaccttgaatttcttgctgggcaccttgtactcgtcggtgatcacggcccagcccacagagttggtgccgatgtccaggccgatgctgtacttcttgtcggctgctgggactccgtggataccgaccttccgcttcttctttggggccatcttatcgtcatcgtctttgtaatcaatatcatgatccttgtagtctccgtcgtggtccagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtg

SEQ ID NO: 883 - DNA, 16322 bp, Artificial Sequence
  Synthetic
aggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaagaggtcatttccggggtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcactgggccaggattctcctcgacgtcaccgcatgttagcagacttcctctgccctctccactgccgaattcctttttcttttttgcctggccggcctttttcgtggccgccggccttttgtcgcctcccagctgagacaggtcgatccgtgtctcgtacaggccggtgatgctctggtggatcagggtggcgtccagcacctctttggtgctggtgtacctcttccggtcgatggtggtgtcaaagtacttgaaggcggcaggggctcccagattggtcagggtaaacaggtggatgatattctcggcctgctctctgatgggcttatcccggtgcttgttgtaggcggacagcactttgtccagattagcgtcggccaggatcactctcttggagaactcgctgatctgctcgatgatctcgtccaggtagtgcttgtgctgttccacaaacagctgtttctgctcattatcctcgggggagcccttcagcttctcatagtggctggccaggtacaggaagttcacatatttggagggcagggccagttcgtttcccttctgcagttcgccggcagaggccagcattctcttccggccgttttccagctcgaacagggagtacttaggcagcttgatgatcaggtcctttttcacttctttgtagcccttggcttccagaaagtcgatgggattcttctcgaagctgcttctttccatgatggtgatccccagcagctctttcacactcttcagtttcttggacttgcccttttccactttggccaccaccagcacagaataggccacggtggggctgtcgaagccgccgtacttcttagggtcccagtccttctttctggcgatcagcttatcgctgttcctcttgggcaggatagactctttgctgaagccgcctgtctgcacctcggtctttttcacgatattcacttggggcatgctcagcactttccgcacggtggcaaaatcccggcccttatcccacacgatctccccggtttcgccgtttgtctcgatcagaggccgcttccggatctcgccgttggccagggtaatctcggtcttgaaaaagttcatgatgttgctgtagaagaagtacttggcggtagccttgccgatttcctgctcgctcttggcgatcatcttccgcacgtcgtacaccttgtagtcgccgtacacgaactcgctttccagcttagggtactttttgatcagggcggttcccacgacggcgttcaggtaggcgtcgtgggcgtggtggtagttgttgatctcgcgcactttgtaaaactggaaatccttccggaaatcggacaccagcttggacttcagggtgatcactttcacttcccggatcagcttgtcattctcgtcgtacttagtgttcatccgggagtccaggatctgtgccacgtgctttgtgatctgccgggtttccaccagctgtctcttgatgaagccggccttatccagttcgctcaggccgcctctctcggccttggtcagattgtcgaactttctctgggtaatcagcttggcgttcagcagctgccgccagtagttcttcatcttcttcacgacctcttcggagggcacgttgtcgctcttgccccggttcttgtcgcttctggtcagcaccttgttgtcgatggagtcgtccttcagaaagctctgaggcacgatatggtccacatcgtagtcggacagccggttgatgtccagttcctggtccacgtacatatcccgcccattctgcaggtagtacaggtacagcttctcgttctgcagctgggtgttttccacggggtgttctttcaggatctggctgcccagctctttgatgccctcttcgatccgcttcattctctcgcggctgttcttctgtcccttctgggtggtctggttctctctggccatttcgatcacgatgttctcgggcttgtgccggcccatcactttcacgagctcgtccaccaccttcactgtctgcaggatgcccttcttaatggcggggctgccggccagattggcaatgtgctcgtgcaggctatcgccctggccggacacctgggctttctggatgtcctctttaaaggtcaggctgtcgtcgtggatcagctgcatgaagtttctgttggcgaagccgtcggacttcaggaaatccaggattgtcttgccggactgcttgtcccggatgccgttgatcagcttccggctcagcctgccccagccggtgtatctccgccgcttcagctgcttcatcactttgtcgtcgaacaggtgggcataggttttcagccgttcctcgatcatctctctgtcctcaaacagtgtcagggtcagcacgatatcttccagaatgtcctcgttttcctcattgtccaggaagtccttgtccttgataattttcagcagatcgtggtatgtgcccagggaggcgttgaaccgatcttccacgccggagatttccacggagtcgaagcactcgattttcttgaagtagtcctctttcagctgcttcacggtcactttccggttggtcttgaacagcaggtccacgatggcctttttctgctcgccgctcaggaaggcgggctttctcattccctcggtcacgtatttcactttggtcagctcgttatacacggtgaagtactcgtacagcaggctgtgcttgggcagcaccttctcgttgggcaggttcttatcgaagttggtcatccgctcgatgaagctctgggcggaagcgcccttgtccaccacttcctcgaagttccagggggtgatggtttcctcgctctttctggtcatccaggcgaatctgctgtttcccctggccagagggcccacgtagtaggggatgcggaaggtcaggatcttctcgatcttttcccggttgtccttcaggaatgggtaaaaatcttcctgccgccgcagaatggcgtgcagctctcccaggtggatctggtgggggatgctgccgttgtcgaaggtccgctgcttccgcagcaggtcctctctgttcagcttcacgagcagttcctcggtgccgtccatcttttccaggatgggcttgatgaacttgtagaactcttcctggctggctccgccgtcaatgtagccggcgtagccgttcttgctctggtcgaagaaaatctctttgtacttctcaggcagctgctgccgcacgagagctttcagcagggtcaggtcctggtggtgctcgtcgtatctcttgatcatagaggcgctcaggggggccttggtgatctcggtgttcactctcaggatgtcgctcagcaggatggcgtcggacaggttcttggcggccagaaacaggtcggcgtactggtcgccgatctgggccagcaggttgtccaggtcgtcgtcgtaggtgtccttgctcagctgcagtttggcatcctcggccaggtcgaagttgctcttgaagttgggggtcaggcccaggctcagggcaatcaggtttccgaacaggccattcttcttctcgccgggcagctgggcgatcagattttccagccgtctgctcttgctcagtctggcagacaggatggccttggcgtccacgccgctggcgttgatggggttttcctcgaacagctggttgtaggtctgcaccagctggatgaacagcttgtccacgtcgctgttgtcggggttcaggtcgccctcgatcaggaagtggccccggaacttgatcatgtgggccagggccagatagatcagccgcaggtcggccttgtcggtgctgtccaccagtttctttctcaggtggtagatggtggggtacttctcgtggtaggccacctcgtccacgatgttgccgaagatggggtgccgctcgtgcttcttatcctcttccaccaggaaggactcttccagtctgtggaagaagctgtcgtccaccttggccatctcgttgctgaagatctcttgcagatagcagatccggttcttccgtctggtgtatcttcttctggcggttctcttcagccgggtggcctcggctgtttcgccgctgtcgaacagcagggctccgatcaggttcttcttgatgctgtgccggtcggtgttgcccagcaccttgaatttcttgctgggcaccttgtactcgtcggtgatcacggcccagcccacagagttggtgccgatgtccaggccgatgctgtacttcttgtcggctgctgggactccgtggataccgaccttccgcttcttctttggggccatcttatcgtcatcgtctttgtaatcaatatcatgatccttgtagtctccgtcgtggtccagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtc

SEQ ID NO: 884 - DNA, 21140 bp, Artificial Sequence
  Synthetic
caggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggagcgactcctgcattaggaaattaatacgactcactataggggaattgtgagcggataacaattcccctgtagaaataattttgtttaactttaataaggagatataccatgggtgaactgccgagtaggtagctgataacagtacagcgcggctgaaatcatcattaaagcggtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcatgaagaggtcatttccggggtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcactgggccaggattctcctcgacgtcaccgcatgttagcagacttcctctgccctctccactgccgaattcctttttcttttttgcctggccggcctttttcgtggccgccggccttttgtcgcctcccagctgagacaggtcgatccgtgtctcgtacaggccggtgatgctctggtggatcagggtggcgtccagcacctctttggtgctggtgtacctcttccggtcgatggtggtgtcaaagtacttgaaggcggcaggggctcccagattggtcagggtaaacaggtggatgatattctcggcctgctctctgatgggcttatcccggtgcttgttgtaggcggacagcactttgtccagattagcgtcggccaggatcactctcttggagaactcgctgatctgctcgatgatctcgtccaggtagtgcttgtgctgttccacaaacagctgtttctgctcattatcctcgggggagcccttcagcttctcatagtggctggccaggtacaggaagttcacatatttggagggcagggccagttcgtttcccttctgcagttcgccggcagaggccagcattctcttccggccgttttccagctcgaacagggagtacttaggcagcttgatgatcaggtcctttttcacttctttgtagcccttggcttccagaaagtcgatgggattcttctcgaagctgcttctttccatgatggtgatccccagcagctctttcacactcttcagtttcttggacttgcccttttccactttggccaccaccagcacagaataggccacggtggggctgtcgaagccgccgtacttcttagggtcccagtccttctttctggcgatcagcttatcgctgttcctcttgggcaggatagactctttgctgaagccgcctgtctgcacctcggtctttttcacgatattcacttggggcatgctcagcactttccgcacggtggcaaaatcccggcccttatcccacacgatctccccggtttcgccgtttgtctcgatcagaggccgcttccggatctcgccgttggccagggtaatctcggtcttgaaaaagttcatgatgttgctgtagaagaagtacttggcggtagccttgccgatttcctgctcgctcttggcgatcatcttccgcacgtcgtacaccttgtagtcgccgtacacgaactcgctttccagcttagggtactttttgatcagggcggttcccacgacggcgttcaggtaggcgtcgtgggcgtggtggtagttgttgatctcgcgcactttgtaaaactggaaatccttccggaaatcggacaccagcttggacttcagggtgatcactttcacttcccggatcagcttgtcattctcgtcgtacttagtgttcatccgggagtccaggatctgtgccacagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtagtcttcagagatggggatgctgttgattgtagccgttgctctttcaatgagggtggattcttcttgagacaaaggcttggccatcggtccaggattctcttcgacatctccggcttgtttcagcagagagaagtttgttgcgccggatccggcatagtcggggacatcatatgggtatgcataatcaggcacgtcgtagggataagcgtaatctggaacatcgtatgggtatttcttcttcttagcctgtccagccttctttgtggcggcaggtcgcttggatcccttgtacagctcatccataccgagagtgatgcctgcggcagtcacaaattccagaaggaccatgtgatctctcttttcgtttgggtccttggaaagctttgattgcgtggagagataatgattgtcaggcaagagtacaggtccatctccgatgggcgtattttgttggtaatgatcagccagttgaacactaccatcttcgacattatgtcggatcttaaagttggcctttatcccatttttctgcttatcagcggtaatatacacattatggctgttaaagttgtactccaacttgtgccccagtatgttaccgtcctccttaaaatcaatacctttcagttcaattcgattaaccagagtgtccccttcaaatttaacctcggctcgggttttatatgtaccatcatccttaaagctgatggtcctttcttgaacataaccttcaggcattgcagacttgaaaaagtcatgctgtttcatgtggtcgggatatcgagaaaagcattgcacgccgtaggtgagggtcgttacgagtgtaggccatgggacgggcagtttgcccgtcgtacagatgaatttcagagtcagcttaccattcgtggcgtccccttcgccttcgcccctgacggagaatttatgtccatttacatctccatcaagctctaccagaatgggcactactccagtgaagagttcttcacctttactcacgctacctcctcctccgcttcctcctcctccgcttccacctcctccttccagggccttgtactcgaacatgactttcacgagttcgcacagttcctcgctgttccggtcggtcatcagtttctttttcttcagattcttcaggtgcacgatcttctctgattccagggtctggatttcgatcttcttgtcagcgccgatcttgaaggtggccacgaagccgtattctttcagaatgtccacgatggacttcatgatggcgttcttcagcttccggtcgtaggacagcagcttccgcaggttttccagcacttccagcaggctaatctcggcgtgggggatgtagttgaagtgggcaatgtagttccggatgtacaggtcctttttttcctgcttcagtttcttcactttcttgtcggagtagatgctccgcttttccacattgtccttgtacagttctttgtagaagttgatatacttttccacgatctggccgcttttgtacttcacattcttggagttgtcgaaattgaaaatttcctcgatgtagtggttctcgggaaactcgcccttcagccggaatctcaggtcccgctcccagatgctggtgtagcccacgagccggtgcaggatcttcagcagcaggccctgcagcaggttcagctcattgaattccaccttgttcttcaggtgggtgtacttctggatgttgccgatggccttctcatactctttgtagtcctcgtcgttgaacttttcgtccttcttgggtctggcgtacttccggtgcaggttctgctgcatggtgtagttcttttcaatctcattcttcttgttgctgtactctttcagttctttcaggctgatcttatacttggccttatcggcgatcttttccagcagattcagcatgccgtatttcttgatattgtagaaggcccggtgcttgatgatgttctcgccgtcgaaatagatcttgttggtgtcgaactttttcagctctttccggtccttgattttgttttcgttgaagtccaggaacttgccgatctcgttggcttccagctcgaagtcctcggtcactctgttgttgtccaggttcagcaggttgatcagttccaactcgtcgctgaaggtttcttctttgttggcggactggtacttttccaggctgcccttcaggttggtcagctctttgtggttcagcagcttcaggatcaggtaaaacatgttcagattctcggtgtacttcagaatcttccccagcttgatctcgcgcacgaactcattgatctcgtgagggatttctttgttccgattgtgcttctcatagttcttcaggatcttgtcgtacttctctttgttatcctttttgatcttgatcttggagaagatgtcgttgttgtcattgttgttgttgctctcgatatacttcagattgttcttgttcaggtagtcgatgaagcccttcaggaaaatctgctgaataaagtcgatgtaggtattcttttcctctttgtcctggttgttgatcatctctctgctctggatgatggccaggtattccacgggcacggttttctcgatgttctcgaacttctgatacttgtagtggccggttttctggttccgctgcttgttaatcttgatcacttcattggtgatcttaaagaacaccttggagtttttcacgaacttgttcaggaactcgccgtagtagatattcttcagcaggtagatctgggcgtccttctcttctttgtccttgggcacgctccaaaaaaacttcagggtattccgcaggtcctcaatcttgttgtacagcttggtgaagctgggcacgaaggggatgtttttgttcacgaagttgaacttggtattcttcaggtacttgatgatcacatccttctcgtagtagttgaacacgttggcgctgttcagctgcttgaagattttcagcttcagcttcttttcgttgatttcgttctgaaacatcttcttggagatctcgctgggggcgatattcttgaaggcgaagatgtccttgccttccagttccaggttgaagtgcacgatgccgtgtctgatgctgctgatggcctcgtcgatgttggcgaagaagtcctcgatctcgttcttgttgtccatgttgaagtcgtagctgtagaacatcttcagattttctttcacttcgttctgcttgttctcattgtagatcttgtccacctcgccggacacgtatttctcttcgcccttgttgttcttcacggtcttgccccgcatccggccggtgataccgttctcgttctcggtttccaggatgttcctcaggctgaagtaggccacgctggacacgccgatgatgtttctcaggaaggcctcgttctgccggttccgggcgataaagtcggaggtggcgatctcgcccacttgcagatagtagttgtacttgccgcagttccgcacgtaggtgtccagcttgttcagcagtttgttttcgatcagctttttcagattctggtactcgaagatccgcttgatcttatcgttgctgatgttgctcagccgcttgtacacgtagtttttcagcagctgggacatctcgatttccacgaagtggcagaaggcgtacttaatattcttgtcgttcagttcctctttgtccaggtagtacttgtagaacacctggcttttcttcagctcagacatgtcggggatcttctcaatcagctctttgatgttgttcacgttctggatctcttcgtagataatcttggcgaagttctctttgtcgttcttccggccgatgatcttgtgatagtactcgcggatcttgtacttctcgtgcttcttgctgttctcgatcaggaaaaacagtttctcgatatcctctttcttatacagcttgtcgaaggcttcctgcacgttgttgatgtagtcgttgcgcttggcgctctctctgtagtagtcgtagatgatgttccgcttgctcttgccgcccactttttccacgttgttctcgttgatcttctggtagttggccttgttctcttcgaagctgtacttcaggctgttgatcttgttcagcttggcttccacgtccttccgaaagatttccagttcctcagagttcacgtcctcgttcagcaggatcttcttcagcacggagaagctgttcttgtttttcaggtcgtactcgctgatgtcctcttcgctatagttcttgtcctgcacggcgttcttttctttccggttcttcagatacagcacgctgtccttcaggtgcagcaccttgttgctaaagaacttcttcaggttctctcttctgatccggttctcttcctcggaggcgttgtcggggttcttgatgtagatgtccagccggatgctcagcagctcgctcagtctctcgctggtccggttttcctcgctggtggacttcacgagcttgccctcttcgatgtacttcttgtggctgatgccgtcgaccttggtcactttcatggatcgtgctttgtgatctgccgggtttccaccagctgtctcttgatgaagccggccttatccagttcgctcaggccgcctctctcggccttggtcagattgtcgaactttctctgggtaatcagcttggcgttcagcagctgccgccagtagttcttcatcttcttcacgacctcttcggagggcacgttgtcgctcttgccccggttcttgtcgcttctggtcagcaccttgttgtcgatggagtcgtccttcagaaagctctgaggcacgatatggtccacatcgtagtcggacagccggttgatgtccagttcctggtccacgtacatatcccgcccattctgcaggtagtacaggtacagcttctcgttctgcagctgggtgttttccacggggtgttctttcaggatctggctgcccagctctttgatgccctcttcgatccgcttcattctctcgcggctgttcttctgtcccttctgggtggtctggttctctctggccatttcgatcacgatgttctcgggcttgtgccggcccatcactttcacgagctcgtccaccaccttcactgtctgcaggatgcccttcttaatggcggggctgccggccagattggcaatgtgctcgtgcaggctatcgccctggccggacacctgggctttctggatgtcctctttaaaggtcaggctgtcgtcgtggatcagctgcatgaagtttctgttggcgaagccgtcggacttcaggaaatccaggattgtcttgccggactgcttgtcccggatgccgttgatcagcttccggctcagcctgccccagccggtgtatctccgccgcttcagctgcttcatcactttgtcgtcgaacaggtgggcataggttttcagccgttcctcgatcatctctctgtcctcaaacagtgtcagggtcagcacgatatcttccagaatgtcctcgttttcctcattgtccaggaagtccttgtccttgataattttcagcagatcgtggtatgtgcccagggaggcgttgaaccgatcttccacgccggagatttccacggagtcgaagcactcgattttcttgaagtagtcctctttcagctgcttcacggtcactttccggttggtcttgaacagcaggtccacgatggcctttttctgctcgccgctcaggaaggcgggctttctcattccctcggtcacgtatttcactttggtcagctcgttatacacggtgaagtactcgtacagcaggctgtgcttgggcagcaccttctcgttgggcaggttcttatcgaagttggtcatccgctcgatgaagctctgggcggaagcgcccttgtccaccacttcctcgaagttccagggggtgatggtttcctcgctctttctggtcatccaggcgaatctgctgtttcccctggccagagggcccacgtagtaggggatgcggaaggtcaggatcttctcgatcttttcccggttgtccttcaggaatgggtaaaaatcttcctgccgccgcagaatggcgtgcagctctcccaggtggatctggtgggggatgctgccgttgtcgaaggtccgctgcttccgcagcaggtcctctctgttcagcttcacgagcagttcctcggtgccgtccatcttttccaggatgggcttgatgaacttgtagaactcttcctggctggctccgccgtcaatgtagccggcgtagccgttcttgctctggtcgaagaaaatctctttgtacttctcaggcagctgctgccgcacgagagctttcagcagggtcaggtcctggtggtgctcgtcgtatctcttgatcatagaggcgctcaggggggccttggtgatctcggtgttcactctcaggatgtcgctcagcaggatggcgtcggacaggttcttggcggccagaaacaggtcggcgtactggtcgccgatctgggccagcaggttgtccaggtcgtcgtcgtaggtgtccttgctcagctgcagtttggcatcctcggccaggtcgaagttgctcttgaagttgggggtcaggcccaggctcagggcaatcaggtttccgaacaggccattcttcttctcgccgggcagctgggcgatcagattttccagccgtctgctcttgctcagtctggcagacaggatggccttggcgtccacgccgctggcgttgatggggttttcctcgaacagctggttgtaggtctgcaccagctggatgaacagcttgtccacgtcgctgttgtcggggttcaggtcgccctcgatcaggaagtggccccggaacttgatcatgtgggccagggccagatagatcagccgcaggtcggccttgtcggtgctgtccaccagtttctttctcaggtggtagatggtggggtacttctcgtggtaggccacctcgtccacgatgttgccgaagatggggtgccgctcgtgcttcttatcctcttccaccaggaaggactcttccagtctgtggaagaagctgtcgtccaccttggccatctcgttgctgaagatctcttgcagatagcagatccggttcttccgtctggtgtatcttcttctggcggttctcttcagccgggtggcctcggctgtttcgccgctgtcgaacagcagggctccgatcaggttcttcttgatgctgtgccggtcggtgttgcccagcaccttgaatttcttgctgggcaccttgtactcgtcggtgatcacggcccagcccacagagttggtgccgatgtccaggccgatgctgtacttcttgtcggctgctgggactccgtggataccgaccttccgcttcttctttggggccatcttatcgtcatcgtctttgtaatcaatatcatgatccttgtagtctccgtcgtggtccagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgt

SEQ ID NO: 885 - DNA, 44 bp, Artificial Sequence
  Synthetic
taatacgactcactataggggaattgtgagcggataacaattcc

SEQ ID NO: 886 - DNA, 35 bp, Artificial Sequence
  Synthetic
ttgacagctagctcagtcctaggtataatactagc

SEQ ID NO: 887 - DNA, 35 bp, Artificial Sequence
  Synthetic
tttacagctagctcagtcctaggtattatgctagc

SEQ ID NO: 888 - DNA, 35 bp, Artificial Sequence
  Synthetic
tttacggctagctcagtcctaggtactatgctagc

SEQ ID NO: 889 - DNA, 35 bp, Artificial Sequence
  Synthetic
tttatggctagctcagtcctaggtacaatgctagc

SEQ ID NO: 890 - DNA, 165 bp, Artificial Sequence
  Synthetic
attgggggcgacggtcaattaagtccagtcatagtgggactggtgtcctaataatttaagcattcttttctagaaatactttgtctttccttgactttcatcagggtggttgttatattagtaattgtgttagcactccattaagttaagtgctaaaaagaggtg

SEQ ID NO: 891 - DNA, 163 bp, Artificial Sequence
  Synthetic
gattgcattaggttttagtttcttgtataatgcttaatgttggtcactgacaggctacgatacggaaggttgctcacgcccggcccctttgccatggctagtgtgtggaaatttccgaggagcaagtctatttccaaaaatgggcgaaaaaggaggtaataca

SEQ ID NO: 892 - DNA, 30 bp, Artificial Sequence
  Synthetic
ttgacaattaatcatccggctcgtataatg

SEQ ID NO: 893 - DNA, 56 bp, Artificial Sequence
  Synthetic
attttacatttttagaaatgggcgtgaaaaaaagcgcgcgattatgtaaaatataa

SEQ ID NO: 894 - DNA, 47 bp, Artificial Sequence
  Synthetic
tgtctcttatgacaaaaagagcaaaattttgataaaatagtattaga

SEQ ID NO: 895 - DNA, 46 bp, Artificial Sequence
  Synthetic
tgagctgtttacaattaatcatcgtgtggtaccatgtgtggaattg

SEQ ID NO: 896 - DNA, 124 bp, Artificial Sequence
  Synthetic
tggcgggatcgttgtatatttcttgacaccttttcggcaccgccctaaaattctgcgtcctcataatatatgaggcgatttattacgtgtttacgaagcaaaagctaaaaccaggagctattta

SEQ ID NO: 897 - DNA, 1229 bp, Artificial Sequence
  Synthetic
acatttccccgaaaagtgccacctgcatcgatttattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccataccc

SEQ ID NO: 898 - DNA, 41 bp, Artificial Sequence
  Synthetic
ggctttacactttatgcttccggctcgtatgttgtgtggaa

SEQ ID NO: 899 - DNA, 15170 bp, Artificial Sequence
  Synthetic
tccgttaagtcatagcgactaatcgctagttcatttgctttgaaaacaactaattcagacatacatctcaattggtctaggtgattttaatcactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcttaagtagcaccctcgcaagctcgggcaaatcgctgaatattccttttgtctccgaccatcaggcacctgagtcgctgtctttttcgtgacattcagttcgctgcgctcacggctctggcagtgaatgggggtaaatggcactacaggcgccttttatggattcatgcaaggaaactacccataatacaagaaaagcccgtcacgggcttctcagggcgttttatggcgggtctgctatgtggtgctatctgactttttgctgttcagcagttcctgccctctgattttccagtctgaccacttcggattatcccgtgacaggtcattcagactggctaatgcacccagtaaggcagcggtatcatcaaggtctgacgctcagtggaacgaaaactcacgttaagggattttggtcatgagattatcaaaaaggatcttcacctagatcctttacgctccgggacgccaacaacaagacccatcatagtttgcccccgcgacattgaccataaattcatcgcacaaaatatcgaacggggtttatgccgcttttagtgggtgcgaagaatagtctgctcattacccgcgaacaccgccgcattcagatcacgcttagtagcgtccccatgagtaggcagaaccgcgtccaagtccacatcatccataacgatcatgcacggggtggaatccacacccagacttgccagcacctcattagcgacacgttgcgcagcggccacgtccttagccttatccacgcaatcgagaacgtactgcctaaccgcgaaatcagactgaatcagtttccaatcatcgggcttcaccaaagcaacagcaacgcgggttgattcgacccgttccggtgcttccagaccggcgagcttgtacagttcttcttccatttcacgacgtacatcagcgtctatgtaatcaatgcccaaagcacgcttagccccacgtgaccaggacgaacgcaggtttttagaaccaacctcatactcacgccaccgagccaccaaaacagcgtccatatcctcgccggcgtcgctttgatcggccaacatatccaacatctgaaacggcgtgtacgaccccttagacgcggttttagtagcggagccagtcagttcctgagacatgcccttagcgaggtaggttgccattttcgcagcgtctccaccccaggtagacacctgatcaagtttgaccccgtgctcacgcagtggcgcgtccataccggccttaaccacaccagcagaccagcgggaaaacatggaatcctcaaacgccttgagttcatcgtcagacagtggacgatccaagaacaacagcatgttgcggtgcaagtgccaaccgttcgcccaagagtctgtgacctcatagtcactataggtgtgctccaccccgtaccgtgcacgttctttcttccactgagatgttttcaccatcgaagagtacgcagtcttaatacccgcttcaacctgcgcaaatgactgtgagcggttgtgtcgaacagtgcccacaaacatcatgagcgcgccacccgccgccaagtgattcttagtagcaatagccagctcaatgcggcgttcgcccatgacttccaattcagccagagatgacccccagcgagagtgagagttttgcagaccctcaaactgcgaagcaccgttagacgaccaggacaccgcaacagcttcgtccctgcgccacctatggcaccccgccagagccttactattggtgatcttgtacatgacgttttgcctacgccacgccctagcgcgagtgaccttagaaccctcattgacctgcggttccttagaggtgttcacttctatttcagtgttacctagacccgatgttgtgcggggttgcgcagtgcgagtttgtgcgggtgttgtgcccgttgtcttagctagtgctatggttgtcaattgaaaccccttcgggttatgtggcccccgtgcatatgagttggtagctcgcacgggggtttgtcttgtctagggactattaatttttagtggtgtttggtggccgcctagcttggctatgcgtgccagcttacccgtactcaatgttaaagatttgcatcgacatgggagggttacgtgtccgatacctagggggggtatccgcgactaggtgccccggtgctcactgtctgtaccggcggggcaagccccacaccccgcatggacagggtggctccgccccctgcacccccagcaatctgcatgtacatgttttacacattagcacgacatgactgcatgtgcatgcactgcatgcagactaggtaaatatgagtatgtacgactagtaacaggagcactgcacataatgaatgagttgcaggacaatgtttgctacgcatgcgcatgacatatcgcaggaaagctactagagtcttaaagcatggcaaccaaggcacagctagaacagcaactacaagaagctcaacaggcactacaggcgcagcaagcgcaggcacaagccaccatcgaagcactagaagcgcaggcaaaggctaagcccgtcgtggtcaccgcacgcgttcctttggcactacgtgaggacatgaagcgcgcaggcatgcagaacggtgaaaacctccaagagttcatgatcgccgcgtttaccgagcggctagaaaagctcaccaccaccgacaacgaggaaaacaatgtctaacccactagttctctttgcccaccgtgacccggtaaatgacgtgacgttcgagtgcattgagcacgccacctacgacacactttcacacgctaaagaccagatcaccgcccaaatgcaagccctagacgaagaagccgccctactgccctaatgggtgtttcatgggtgtttccctagtgtttcatggtgttttcacctaagctagggaattgcgcgagaagtctcgcaaaaatcagcaacccccggaaccacacagttcacgggggttcttctatgccagaaatcagaaaggggaaccagtgaacgaccccgaatggctggatgatcctccttgggccacgcccacccggcgatcatcgaggcggtcaccggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactccaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcggatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgcggaatcatgacctgagctgtttacaattaatcatcgtgtggtaccatgtgtggaattggaaaggacttgaacgacacgtggagatataccatgggtgaactgccgagtaggtagctgataacgagacctctgtcttgtcagctagggtggtctcgtgaactgccgagtaggtagctgataacggatccgaattcgagcgaaggagatatacatatgtttttgcaaagacctaaaccttacagcgatgaaagtttagaaagtttctttatccgagtggctaacaaaaatggctacggtgatgtccatcgcttcctagaagccactaaacgattccttcaagacattgaccataatggctatcaaacctttccgactgatataactcggataaacccatactcagctaaaaacagttccagcgcacgaactgcgtcattcctgaaacttgcacaattgacatttaatgaaccgccagagctacttgggttggcaattaacagaacaaacatgaaatactcgccgtcaactagcgcggttgttagaggtgcagaagtctttcctcgcagtttactacggacgcactccatcccctgctgtcctttgtgtctgcgagaaaatggctacgcctcctacctttggcactttcaggggtacgaatactgccacagccataacgtacctttaattaccacttgtagctgtggtaaggagtttgactaccgagtatctgggttaaagggcatttgctgcaaatgcaaggagcctatcaccttaaccagcagggagaacggtcatgaggcagcgtgtactgtttcaaactggcttgctggccatgaatctaaacctctgccaaatcttcctaaaagctaccgatggggtttagttcattggtggatgggtattaaagatagcgagttcgatcacttttcgttcgttcaatttttctcaaactggccaaggtcattccactcgataatcgaagatgaagtagagttcaaccttgagcatgctgttgtcagcacgtctgaattacgactaaaagatcttcttggtcgattgtttttcggttcaattcggttacctgagcggaatcttcaacacaatatcatccttggtgagcttctctgctatttagaaaatcgtttatggcaagacaagggattaatcgccaacctcaaaatgaacgcgttagaggcgactgtaatgttaaattgtagcctcgatcagattgcatcaatggttgaacaacgcatcttgaagccaaatcgaaaaagcaagcccaacagccctcttgatgttaccgattatctatttcatttcggcgatattttctgtctttggttagctgagttccaaagcgatgagtttaaccgttcgttttatgtgtcgaggtggtaaatgcaaactctgaaagaactaatcgcatccaatcctgacgacttaacaactgaacttaagagagcatttcgtccactcacaccgcatattgcaattgatggtaatgaacttgacgcactgacgatattagtcaatttaaccgataagactgatgatcagaaagacctgctcgatcgagccaaatgcaagcaaaaacttcgagatgaaaaatggtgggctagctgcataaattgcgttaattacagacaaagccataacccaaaattcccggatatacgttctgaaggcgtgattcgaacccaagccctgggtgaattaccgagtttcctactctcgtcctcaaaaatcccaccataccattggtcatatagccatgattcaaaatacgtcaacaaaagcgcattcctcaccaatgagttttgttgggatggtgagatctcatgtttgggtgagcttcttaaagatgcagatcacccactttggaatactttgaaaaagttaggttgttctcaaaaaacttgcaaagcaatggcaaaacaactagctgatattactctcacgactatcaatgtcacactcgcaccaaattacctgactcaaatatctctccccgatagtgatacatcctacatttcactctctcctgttgcatcgctatcgatgcaaagccactttcatcagaggctccaagatgaaaatcggcatagcgcgataacgcggtttagccgaactaccaacatgggggtcactgcgatgacatgtggcggcgcatttagaatgttaaagtctggcgctaagttttccagcccccctcatcaccgattaaacagtaaacgaagttggttgacgtcagagcatgttcagtcattaaaacagtaccagcgcctcaacaaaagcctcatacctgaaaactctcggattgcactccgtagaaaatacaaaatcgagcttcaaaatatggtcagatcttggtttgcaatgcaagaccatacccttgattcgaacatacttatccaacatttgaatcatgacctatcttacttaggagccacaaaacgttttgcatacgatccagcgatgaccaagctctttactgagcttttgaaacgagagttatcaaattcaatcaataatggtgagcaacacactaatggatcgtttttagtcctaccgaatatcagggtttgtggcgcaacagctttaagctccccggtaacggtggggattccatcacttacagctttctttggcttcgttcacgcatttgaacggaatataaatcgcaccacctcatcgtttcgtgttgaatcctttgcgatatgcgtccatcaactacatgtcgagaagcgaggtttgacagcagagtttgtggaaaaaggcgacgggactatatccgctcccgcgacccgggatgactggcagtgtgatgtcgtatttagccttattttgaacaccaactttgctcaacatattgaccaagatacgttagttacatcactaccaaagcgattggctcggggttcagcaaaaattgcgattgatgactttaaacatatcaactcattctcgacattagaaacagcgatcgaatctctgccaatagaagctggtaggtggttatcactttacgcacagtcaaacaataatctaagtgatctattagcagccatgacagaggaccatcagctcatggcaagctgcgtcggttaccacttgttagaagagcccaaagataaaccaaactccctcagaggttacaaacacgctatcgccgagtgcatcattggactcattaactcaatcacctttagctcagagactgatcccaacacaatcttttggtcgctaaagaactatcaaaactacctagtggtacagccaaggagtatcaacgatgaaactaccgacaaatctagcctatgagcgctctatcgacccatcagatgtctgtttttttgtcgtctggcccgatgatagaaaaacacctttaacctacaattctcgtactctgctcgggcaaatggaagcggcatcattagcctatgatgtctcaggtcaaccaataaaaagtgccaccgctgaggcgttagctcaagggaaccctcatcaagttgatttctgccacgttccatacggtgcgagtcatattgaatgcagtttctccgtctcgttttcttctgaactacgtcaaccatataagtgtaactcaagcaaagttaaacaaacgctagtgcaattagtcgagctctacgaaacgaaaatcggctggactgagctagcaacccgatatttgatgaacatttgcaacggtaaatggctgtggaaaaatacccgtaaagcctattgctggaacattgtacttacaccttggccttggaacggggaaaaggttggatttgaagatattcgtactaactacacctcacggcaagactttaaaaataataaaaattggtctgctatagttgaaatgatcaaaaccgcattttctagtactgatgggctggcgatatttgaagtcagggccaccttgcacttgccaacgaatgctatggtgcggccaagccaagttttcacagaaaaagaaagtggcagtaaaagtaaatctaaaactcaaaacagtcgagtttttcagagtacaactattgatggtgaacgatcgccaatactaggggcctttaaaacgggagcagctattgcaaccattgacgactggtatcctgaagccactgagccactaagggtcggacggtttggggttcatcgcgaagatgtcacttgctaccgtcatccgtctaccggaaaagattttttctcgatattacaacaagcagagcactatattgaagtgttgagcgccaacaaaactcccgctcaagaaactatcaacgacatgcactttttaatggctaacctgattaagggtgggatgttccagcataaaggagactgactgtgaaatggtattataagacaatcacctttctgccagagttgtgcaacaacgagtcactggctgcaaagtgtctccgcgttctgcatggatttaactatcagtatgagacacgaaatatcggcgtttcatttccgctttggtgtgatgcaacggttggaaaaaagatttcatttgtcagcaagaacaagatagaactcgacttactacttaaacaacactatttcgtccaaatggaacaacttcaatactttcatatatccaacactgttctcgtcccagaagattgtacatacgtttcctttagacgctgtcaatctatagataagctcacagcagcagggctggcaaggaaaatcagacgcctggagaaacgtgctctatctagaggcgagcaatttgacccatcatcttttgctcaaaaagagcatactgcaatagcgcactaccactcacttggggagtccagcaaacagacgaaccgcaactttcgactcaatatcaggatgctctcggagcaaccccgtgaggggaactcgatttttagtagctatggcttatcaaattcagaaaactcgtttcagcctgtacccttaatctgacctttaataaggagatataccatggcgacaagtttacctacgccctcagcaattacgacttcggcgttagagtatgcattccatactcccgctcgcaatctaacgaaatctcgcggaaaaaacattcatcgttatgtcagtgtaaagatgagtaagaggattacggtagaatctactctagagtgtgatgcctgctatcactttgattttgagccaagtattgttcgcttttgcgctcaaccgattcgatttttatattatctcaatggtcagtctcactcctatgttcctgactttctagttcaatttgataccaacgagtttgttctatatgaagtaaagtcagcttatgctaagaacaaacctgattttgatgttgaatgggaggcgaaagtaaaagcagcaactgaactagggctagaattggagcttgttgaagagagtgatattagggatacggttgtattaaataatcttaagcgcatgcatcgttatgcttcgaaagatgagctgaataacgtacataactctctcttaaaaataataaagtacaatggcgcccaatctgcaagatgcttgggagaacagttgggtttaaaaggccgaactgttttaccaattttgtgcgatttgctgtcaaggtgtttactcgatacacgtttggataagcctctatctcttgaatctcgatttgagttggccagttatggctaagaaagggttctcaagtttccatagaaaagcagtctcttcccaagatacgcttgaatcgatagagcttgtctctagcgctaattgtctagaaagtgttacgtatcaagatatatcagcatttcccgaaacaattgcggtagagattaatttccgattaagcattcttcgctttttagcgcgaaagtgcgaaaccattgtggccaaatcaattgaaccacatcgtgtagagctacagcaaaactatagtagaaaaatacccagtgcaataacgatatatcgatggtggcttgcttttcgaaaatcagactacaaccccattagcttagcacctaatatcaaggatagaggtaatagagagacaaaagtgtcaacagttgttgattctattatggaacaggcagttgaaagagttatatctggacgaaaagtcaatgttagctctgcatataaacgtgttcgacgaaaagttcgtcaatacaatctaactcatggaacgaaatacacgtatcctaagtacgaatctgtaagaaagcgagtaaaaaagaaaaccccatttgagttattagccgcagggaaaggggagagagtagctaagagagagtttcgccgaatgggaaaaaagatcctcacgtctagcgtgctagagagggttgaaatagatcacactgtcgttgacctttttgcagtacacgaagagtatcgaatcccattgggccgaccttggcttactcaattggttgattgttacagtaaagctgtaatcggtttttatttaggtttcgagcctcctagctatgtgtcggtttcccttgcacttaagaatgcaatacaacgcaaagatgacttaatctcctcgtatgaatcgatcgagaatgaatggctatgttatggcatcccagacctactcgtaactgataatggtaaagagtttttgtcgaaagcatttgatcaagcatgtgaatcactattgatcaatgtgcatcaaaataaagttgagacgcccgacaacaaacctcatgttgaacgtaactacgggactattaatacttctctgttagacgatttacctgggaaatccttcagccagtaccttcaaagagaagggtacgactctgtgggagaagctacccttacactcaatgagattagagaaatttacttaatttggttggtggatatttatcataaaaaacccaatcagagaggcactaattgtcctaatgttgcgtggaaaaagggttgtcaagaatgggaaccagaggagttctctggttctaaagacgaattagactttaaatttgctattgttgattacaaacaacttactaaagtagggataactgtctacaaagaactgagttatagcaatgaccgtttagctgaatatagagggaagaaaggaaaccataaagttcagttcaagtataaccctgagtgtatggcagttatttgggtgttggatgaggatatgaatgagtactttacagttaatgcgattgactacgaatatgcaagtagagtatcactttggcaacataaatataacatgaaatatcaagcagaactaaattcagcagaatatgatgaggacaaggaaattgatgcagaaataaaaattgaagaaatcgcagatcgttcaattgttaagactaacaaaatcagagctcggaggcgtggcgctaggcatcaagagaatagcgcaagggctaagtcaatcagtaatgcgaacccggcctcgatacaaaaacatgaagatgaaatcgttagtgcagataatgacgattgggatattgattatgtctgagaaatcgtcaaatgagtgaaacgcgtgaggctcgtatatcaagagctaaaagggcatttgtatccacaccgagcgttaggaaaatcttgagttacatggatagatgtagagatctatcagacctagagtctgagcctacatgcatgatggtctatggtgcttcgggtgtaggtaaaacgaccgtcatcaagaaatacttaaatcaaaacagaagagagtccgaagccgggggcgatataataccggttttgcatattgagttgccagacaatgcgaagccagtagatgcagcaagggaattgctggttgaaatgggtgacccgctagcactttatgaaactgacttagctagattgacgaaaagactgactgaattaatccctgcggtcggcgtgaagctgattattatcgatgagttccaacatttggtggaagaaaggtcaaatcgggttcttacccaagtaggtaattggctaaaaatgatacttaacaaaacgaaatgtccaattgttatatttggtatgccatactcaaaagttgtactgcaagcaaactcgcaacttcacgggcgattttccattcaggttgaactgcgcccctttagctaccagggaggtagaggtgtatttaaaacttttttggaataccttgataaagccctaccttttgaaaaacaggctggcttagccaacgaaagtttgcagaaaaaattgtatgcattctctcagggaaacatgcgttcgttgagaaaccttatttatcaagcatctatcgaagcaattgataatcagcatgagacgataaccgaagaagatttcgtttttgcatcgaagttgacatcgggcgataaacccaactcatggaaaaatccttttgaggagggtgttgaggtaacagaagatatgttacgaccgccaccaaaagatattggttgggaggactatttgagacattcaaccccgagagtgagtaaaccaggtagaaataaaaactttttcgaataacctaggctgctgcgctgctgccaccgctgagcaataactagcataaccccttggggcctctaaacgggtcttgaggggttttttgctgaaacctcaggcatttgttgttgatacaaccataaaatgataattacacccataaattgataattatcacacccataaattgatattgcctcttcatggtctaaacttcagtaagtttacgacattttcctcgaggtcatttccggggatccatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttctagagtccttactgcagtagttttgctgaaatactcgattcacaaaaatatcaacttatggttgttttgtgagatatcaatatatggttgttttgtggttaagttgctgattataaataattattaaatatcactttatggttgcatcaacaggtaccgagctcgaattcactggccgtcgttttacaacgtcgtgactgggaaaaccctggcgttacccaacttaatcgccttgccactgatagatacaagagccataagaacctcagatccttccgtatttagccagtatgttctctagtgtggttcgttgtttttgcgtgagccatgagaacgaaccattgagatcatgcttactttgcatgtcactcaaaaattttgcctcaaaactggtgagctgaatttttgcagttaaagcatcgtgtagtgtttttcttagtccgttatgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgc

(The sequence listing continues in the following parts.)

---

What is claimed is:

1. A system for RNA-guided DNA integration, the system comprising one or more vectors heterologous to *Vibrio cholerae* encoding:
    a) an engineered Clustered Regularly Interspaced Short Palindromic Repeats (CRISPR)-CRISPR associated (Cas) (CRISPR-Cas) system, the engineered CRISPR-Cas system comprising: Cas5, Cas6, Cas7 and Cas8; and
    b) an engineered transposon 7-like (Tn7-like) transposon system, the engineered Tn7-like transposon system comprising: i) Transposon 7 protein A (TnsA) TnsA, ii) Transposon 7 protein B (Tns B), iii) Transposon 7 protein C (Tns C), and iv) transposition of integron protein Q (TniQ),
    wherein the engineered Tn7-like transposon system is derived from *Vibrio cholerae* Tn6677.

2. The system of claim 1, wherein the CRISPR-cas system is a Type I-F CRISPR-cas system.

3. The system of claim 1, wherein said CRISPR-cas system is a Type I-F variant where the Cas8 and Cas5 form a Cas8-Cas5 fusion.

4. The system of claim 1, further comprising a guide RNA (gRNA), wherein the gRNA is specific for a target site.

5. The system of claim 1, further comprising a donor DNA to be integrated, wherein the donor DNA comprises a cargo nucleic acid sequence and first and second transposon end sequences, wherein said cargo nucleic acid sequence is flanked by said first and second transposon end sequences, and wherein each of said first and second transposon end sequences comprises at least one TnsB binding site.

6. The system of claim 5, wherein said first and second transposon end sequences are Tn7-like transposon end sequences.

7. The system of claim 1, wherein the CRISPR-Cas system and the Tn7-like transposon system are on the same vector.

8. The system of claim 1, wherein the engineered CRISPR-Cas system is nuclease-deficient.

9. The system of claim 1, wherein said one or more vectors are plasmids.

* * * * *